United States Patent
Peles et al.

(10) Patent No.: US 9,894,861 B2
(45) Date of Patent: Feb. 20, 2018

(54) DETERMINATE CASTOR

(71) Applicant: Kaiima Bio Agritech Ltd., Kfar-Tavor (IL)

(72) Inventors: Yuval Peles, Kibbutz MaAgan (IL); Alon Lerner, Moshav Sharona (IL); Asaf Meiri, Kiryat-Ata (IL); Itay Dodek, Kfar-Tavor (IL); Sahar Gelfman, Hod-HaSharon (IL); Aviad Freiman, Kfar Kish (IL); Yaniv Lerenthal, Kiryat-Ono (IL); Lilah Rothem, Kibbutz Megiddo (IL)

(73) Assignee: Kaiima Bio Agritech Ltd., Moshav Sharona (IL)

( * ) Notice: Subject to any disclaimer, the term of this patent is extended or adjusted under 35 U.S.C. 154(b) by 0 days.

(21) Appl. No.: 15/209,798

(22) Filed: Jul. 14, 2016

(65) Prior Publication Data

US 2017/0035012 A1 Feb. 9, 2017

Related U.S. Application Data

(60) Provisional application No. 62/278,115, filed on Jan. 13, 2016, provisional application No. 62/193,252, filed on Jul. 16, 2015.

(51) Int. Cl.
*A01H 5/10* (2006.01)
*C07K 16/16* (2006.01)

(52) U.S. Cl.
CPC ............... *A01H 5/10* (2013.01); *C07K 16/16* (2013.01)

(58) Field of Classification Search
None
See application file for complete search history.

(56) References Cited

U.S. PATENT DOCUMENTS

2013/0254913 A1* 9/2013 Avidov .................... A01H 5/10
800/260
2015/0033414 A1 1/2015 Chua et al.

FOREIGN PATENT DOCUMENTS

WO WO 2014/064704 5/2014
WO WO 2017/009847 1/2017

OTHER PUBLICATIONS

Merkouropoulos et al 2016, Euphytica 210: 207-219.*
Tahery et al 2011, World Applied Science Journal 12(4): 545-551.*
Tepora 1994, IAEA-TECDOC-781 Dec. 1994, pp. 149-157.*
Andres et al. "The Genetic Basis of Flowering Responses to Seasonal Cues", Nature Reviews Genetics, 13(9): 627-639, Sep. 2012.
Baldanzi et al. "Redesign of the Castorbean Plant Body Plan for Optimal Combine Harvesting", Annals of Applied Biology, 142(3): 299-306, 2003.
Baldanzi et al. "Selection for Non-Branching in Castor, *Ricinus communis* L.", Plant Breeding, 117(4): 392-394, 1998.
Freiman et al. "Development of a Transgenic Early Flowering Pear (*Pyrus communis* L.) Genotype by RNAi Silencing of PcTFL1-1 and PcTFL1-2", Planta, 235: 1239-1251, Published Online Dec. 28, 2011.
Severino et al. "A Review on the Challenges for Increased Production of Castor", Agronomy Journal, 104(4): 853-880, Published Online Apr. 2, 2012.
Tahery et al. "Terminal Flower 1(TFL1) Homolog Genes in Dicot Plants", World Applied Sciences Journal, 12(4): 545-551, 2011.
Wickland et al. "The Flowering Locus T/Terminal Flower 1 Gene Family: Functional Evolution and Molecular Mechanisms", Molecular Plant, 8: 983-997, Jul. 2015.
International Search Report and the Written Opinion dated Dec. 16, 2016 From the International Searching Authority Re. Application No. PCT/IL2016/050769. (8 Pages).
Benlloch et al. "Floral Initiation and Inflorescence Architecture: A Comparative View", Annals of Botany, 100(3): 659-676, Published Online Aug. 6, 2007.
Prenner et al. Is LEAFY a Useful Marker Gene for the Flower-Inflorescence Boundary in the Euphorbia Cyathium?, Journal of Experimental Botany, 62(1): 345-350, Advance Access Publication Oct. 21, 2010.
Tiwari et al. "The EDLL Motif: A Potent Plant Transcriptional Activation Domain From AP2/ERF Transcription Factors", The Plant Journal, 70(5): 855-865, Published Online Mar. 12, 2012.

* cited by examiner

*Primary Examiner* — David H Kruse

(57) ABSTRACT

A determinate castor is provided. Also provided are methods of generating and using same as well as products thereof.

9 Claims, 6 Drawing Sheets
(3 of 6 Drawing Sheet(s) Filed in Color)

Contig resulting from targeted sanger sequencing of the determinate castor. Nucleotides flanking the deleted region are highlighted

```
>Breakpoint_sequencing_results (SEQ ID NO: 2)
TTCATTCCTGAGCACTGTACTGGTATTTGAACCAGTAGGTTCTAAAGGACCATCCAACTT
ACTGATTCCACTAACACCAGGGGAAGATTTTGACCTGCGACACATAAGAAACTCATTAAC
ACAACAAACTTGTTCCTTTTTTTTCCCATCATAACATAAAAAATAGAACAATTTCAXXC
AATGAATTTACAAAATAAATAGCATTTTTTCAAAAAATGACATTAATGTGACAATCATTT
ACTGAAAACTAAAAATAAAAATAAAAAATATATTTTTAAATATTTTTTATACTTTTTCT
TTACTCATTTTTAAAATTTTTAAAAATGTAATCTATATTATTAATATAATTACATTTTT
TAGATAGTTTGTATTTTTAGTTAATTAAAAATTAAATTATTGAAACAGTGACATGCCTNA
ATCACTA
```

FIG. 3A

```
Score = 446 bits (241), Expect = 1e-126
Identities = 247/250 (99%), Gaps = 1/250 (0%)
Strand=Plus/Minus Query   178   ACCAATGAATTTACAAAATAAATAGCATTTTTTCAAAAAATGACATTAATGTGACAATCA   237
              |||||||||||| |||||||||||||||||||||||||||||||||||||||||||||||
Sbjct   60520  ACCAATGAATTTGCAAAATAAATAGCATTTTTTCAAAAAATGACATTAATGTGACAATCA   60461

Query   238   TTTACTGaaaactaaaaataaaaataaaaaatatattttaaatattttttatacttttt   297
              ||||||||||||||||||||||||||||||||||||||||||||||||||||||||||||
Sbjct   60460  TTTACTGAAAACTAAAAATAAAAATAAAAAATATATTTTTAAATATTTTTTATACTTTTT   60401

Query   298   tctttactcattttttaaaattttttaaaaatgtaatctatattattaatataattacattt   357
              ||||||||||||||||||||||||||||||||||||||||||||||||||||||||||||
Sbjct   60400  TCTTTACTCATTTTTAAAATTTTTAAAAATGTAATCTATATTATTAATATAATTACATTT   60341

Query   358   ttttAGATAGTTTGTATTTTTAGTTAATTAAAAATTAAATTATTGAAACAGTGACATGCC   417
              ||| ||||||||||||||||||||||||||||||||||||||||||||||||||||||||
Sbjct   60340  TTT-AGATAGTTTGTATTTTTAGTTAATTAAAAATTAAATTATTGAAACAGTGACATGCC   60282

Query   418   TNAATCACTA   427
              | |||||||||
Sbjct   60281  TTAATCACTA   60272

Score = 324 bits (175), Expect = 5e-90
Identities = 177/178 (99%), Gaps = 0/178 (0%)
Strand=Plus/Minus Query   1     TTCATTCCTGAGCACTGTACTGGTATTTGAACCAGTAGGTTCTAAAGGACCATCCAACTT   60
              |||||||||||||||||||||||| |||||||||||||||||||||||||||||||||||
Sbjct   152306 TTCATTCCTGAGCACTGTACTGGTATCTGAACCAGTAGGTTCTAAAGGACCATCCAACTT   152247

Query   61    ACTGATTCCACTAACACCAGGGGAAGATTTTGACCTGCGACACATAAGAAACTCATTAAC   120
              ||||||||||||||||||||||||||||||||||||||||||||||||||||||||||||
Sbjct   152246 ACTGATTCCACTAACACCAGGGGAAGATTTTGACCTGCGACACATAAGAAACTCATTAAC   152187

Query   121   ACAACAAACTTGTTCCttttttttCCCATCATAACATAAAAAATAGAACAATTTCAA    178
              ||||||||||||||||||||||||||||||||||||||||||||||||||||||||||
Sbjct   152186 ACAACAAACTTGTTCCTTTTTTTTCCCATCATAACATAAAAAATAGAACAATTTCAA    152129
```

FIG. 3B

DETERMINATE CASTOR

RELATED APPLICATIONS

This application claims the benefit of priority under 35 USC 119(e) of U.S. Provisional Patent Application No. 62/193,252 filed on Jul. 16, 2015 and 62/278,115 filed on Jan. 13, 2016, the contents of which are incorporated herein by reference in their entirety.

SEQUENCE LISTING STATEMENT

The ASCII file, entitled 66492SequenceListing.txt, created on Jul. 14, 2016 comprising 833,874 bytes, submitted concurrently with the filing of this application is incorporated herein by reference.

FIELD AND BACKGROUND OF THE INVENTION

The present invention, in some embodiments thereof, relates to a determinate castor, products thereof and methods of generating same.

Castor (Ricinus communis L.) is a non-food crop mainly utilized as a natural source of hydroxylated fatty acids. India, China and Brazil are traditionally the chief growers, while more developed countries are the major consumers of castor seed oil. In the 1960s castor was a promising crop in the Texas High Plains, but in 1972 changes in federal farm programs ended production in the USA. However, recently research efforts are resumed towards the production of castor seed oil containing significant levels of ricinoleic acid. This renewed interest in castor seed oil is also strengthened by the widespread applications of ricin as a potential therapeutic agent for many human diseases.

Castor is generally considered an annual crop herb, shrub or tree according to the different climatic zones, tropical or temperate, where it grows. In castor, the axillary buds into new shoots and branches. To allow the cultivation of castor in a modern agricultural context, the selection of a new genotype suitable for combine harvesting is desirable.

Castor genotypes with low tendencies to branch have been selected using the pedigree method, reviewed in Baldanzi and Pugliesi 1998 Plant Breeding 117:392-394. However successive rounds of self-pollination of these cultivars reduced plant vigor. It is reported that the selection for short and nonbranching castor plants usually has been difficult due to the high genotype vs. environment interaction (see Severino et al. 2012 Agronomy J. 104(4):853-880).

Flowering plants exhibit one of two types of inflorescence architecture: indeterminate, in which the inflorescence grows indefinitely, or determinate, in which a terminal flower is produced. Two important genes of the flowering pathways are FLOWERING LOCUS T (FT) and TERMINAL FLOWER 1 (TFL1). FT and TFL1 encode a pair of flowering regulators which function in diverse signaling pathways. FT and TFL1 share high level of homology (above 60% at the amino acid level) but function in an opposite manner. FT promotes the transition to reproductive development and flowering, whereas TFL1 represses it. Thus, a loss of function in TFL-1 has been associated with a determinate phenotype and early flowering.

To date transgenic silencing of TFL1 for obtaining a determinate phenotype and/or early flowering phenotype has been successfully implemented in various plant families (reviewed Dickland and Hanzawa 2015 Molecular Plant 1-15). However, in industrial plants from the Euphorbiaceae family, including prominent plants such as Jatropha, TFL-1 has recently been found to be a flowering promoter rather than a repressor. U.S. Patent Publication Number 20150033414 teaches a method of promoting flowering time in Jatropha and related plants e.g., castor, by transgenic expression of the flower promoting activity of the JcTFL1L-1 protein.

SUMMARY OF THE INVENTION

According to an aspect of some embodiments of the present invention, there is provided a non-genetically modified determinate castor plant.

According to some embodiments of the invention, the plant comprises a loss of function genetic alteration in TFL1 locus.

According to some embodiments of the invention, the plant comprises a loss of function genetic alteration conferring a determinate phenotype in a genetic locus selected from the group consisting of the genetic loci listed in Table 5.

According to some embodiments of the invention, the genetic alteration comprises a deletion.

According to some embodiments of the invention, the deletion is on Scaffold 30055 (SEQ ID NO: 1).

According to some embodiments of the invention, the deletion is flanked by primers L3-F (SEQ ID NO: 10) and R6-R (SEQ ID NO: 57).

According to some embodiments of the invention, the deletion is lacking an SNP marker selected from the group of SNPs in Table 2 above.

According to some embodiments of the invention, a breakpoint of the deletion is defined by SEQ ID NO: 2.

According to some embodiments of the invention, the plant presents stable vigor for at least 5 generations.

According to some embodiments of the invention, the plant has a G nucleotide in position 371820 of SEQ ID NO: 1 in a homozygous form.

According to an aspect of some embodiments of the present invention, there is provided a determinate castor plant, having been genetically modified to down-regulate activity or expression of TFL1 (SEQ ID NO: 3 or 4).

According to an aspect of some embodiments of the present invention, there is provided a determinate castor plant having been genetically modified to down-regulate activity or expression of a gene selected from the group consisting of SEQ ID NO: 67-90 or a polypeptide expression product thereof selected from the group of SEQ ID NOs: 126, 119, 120, 121, 123, 127, 128, 124, 129, 125, 122 and 130.

According to some embodiments of the invention, the determinate castor plant comprises an RNA silencing agent designed to down-regulate expression of the TFL1 or the genes encodable by SEQ ID NO: 67-90.

According to some embodiments of the invention, the determinate castor plant comprises a DNA nuclease to down-regulate activity or expression of the TFL1.

According to some embodiments of the invention, the determinate castor plant is an inbred line.

According to an aspect of some embodiments of the present invention, there is provided a part of the castor plant.

According to some embodiments of the invention, the part of the castor plant is a seed.

According to an aspect of some embodiments of the present invention, there is provided a hybrid seed of the castor plant.

According to an aspect of some embodiments of the present invention, there is provided a hybrid plant obtained by growing the hybrid seed.

According to an aspect of some embodiments of the present invention, there is provided a plant part of the hybrid plant.

According to an aspect of some embodiments of the present invention, there is provided a method of selecting a determinate castor plant, the method comprising detecting in a genome of a castor plant a loss of function genetic alteration in a chromosomal region flanked by L3-F (SEQ ID NO: 10) and R6-R (SEQ ID NO: 57) or a G nucleotide in position 371820 of SEQ ID NO: 1 being in linkage disequilibrium with the deletion, wherein presence of a loss of function genetic alteration or the in the chromosomal region is indicative of a determinate castor plant.

According to some embodiments of the invention, the loss of function genetic alteration comprises a deletion.

According to some embodiments of the invention, the loss of function genetic alteration conferring the determinate phenotype is a genetic locus selected from the group consisting of the genetic loci listed in Table 5.

According to some embodiments of the invention, a breakpoint of the deletion is defined by SEQ ID NO: 2.

According to some embodiments of the invention, the detecting is effected by analyzing a SNP selected from these SNP positions 101086, 110318, 123602, 129239, 146591 of SEQ ID NO: 1.

According to an aspect of some embodiments of the present invention, there is provided a method of producing a determinate castor plant, the method comprising:
(a) crossing or selfing a castor plant comprising a loss of function genetic alteration in a gene locus of a chromosomal region flanked by L3-F (SEQ ID NO: 10) and R6-R (SEQ ID NO: 57), the loss of function genetic alteration being in a heterozygous form, so as to obtain F1 seeds;
(b) growing an amount of the F1 seeds into F1 plants;
(c) generating offspring plants of the F1 plants by crossing or selfing;
(d) selecting from among the offspring plants a plant that comprises the loss of function genetic alteration in a homozygous form, the plant being a determinate castor plant.

According to some embodiments of the invention, the selecting is effected by analyzing presence in the genome of the plant of at least one marker selected from the group consisting of 101086-146591.

According to an aspect of some embodiments of the present invention, there is provided a determinate castor plant for which representative seeds have been deposited under the Budapest Treaty on Nov. 2, 2015 in the NCIMB Ltd. under NCIMB 42477 (VS011), NCIMB 42478 (VS018), NCIMB 42479 (VS025), NCIMB 42480 (VS030) or NCIMB 42481 (VS033). All the deposits are F1 hybrids as in Table 6 below.

According to an aspect of some embodiments of the present invention, there is provided oil produced from the plant.

According to an aspect of some embodiments of the present invention, there is provided a method of producing oil, the method comprising:
(a) providing seeds of the castor plant;
(b) extracting oil from the seeds.

According to an aspect of some embodiments of the present invention, there is provided a cake of the castor plant.

According to an aspect of some embodiments of the present invention, there is provided a method of producing a cake, the method comprising:
(a) providing seeds of the castor plant;
(b) crushing the seeds so as to obtain crushed seeds, and
(c) removing oil from the crushed seeds, thereby producing the cake.

According to an aspect of some embodiments of the present invention, there is provided a castor meal.

According to an aspect of some embodiments of the present invention, there is provided a processed product of the plant, wherein the product comprises DNA of the plant.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

The file of this patent contains at least one drawing executed in color photograph. Copies of this patent with color photograph(s) will be provided by the Patent and Trademark Office upon request and payment of necessary fee.

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
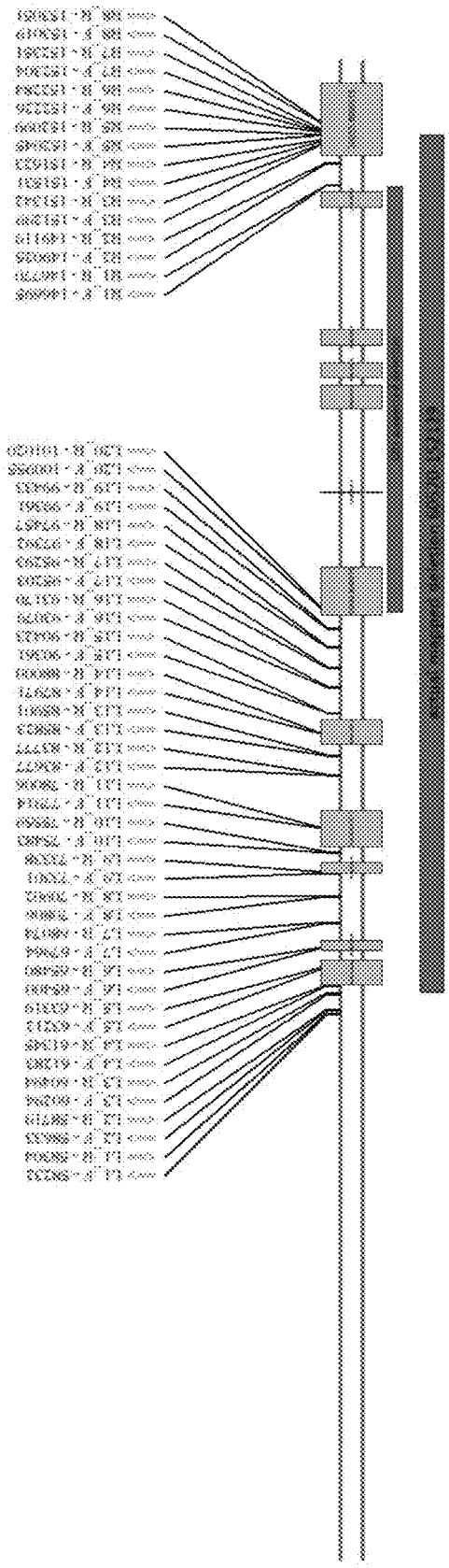

FIG. 1 is a schematic representation of nucleotides 1-160,000 of scaffold 30055 (*Ricinus comunnis* version TIGR/JCVI v0.1). The scheme depicts the deletion region deduced from the GBS dataset, primers used for fine mapping of the actual deletion breakpoints (listed in Table 4 below) and the final mapped deleted region. Genes annotated within the region of interest are depicted as green rectangles (listed in Table 5 below).

Figure 2:
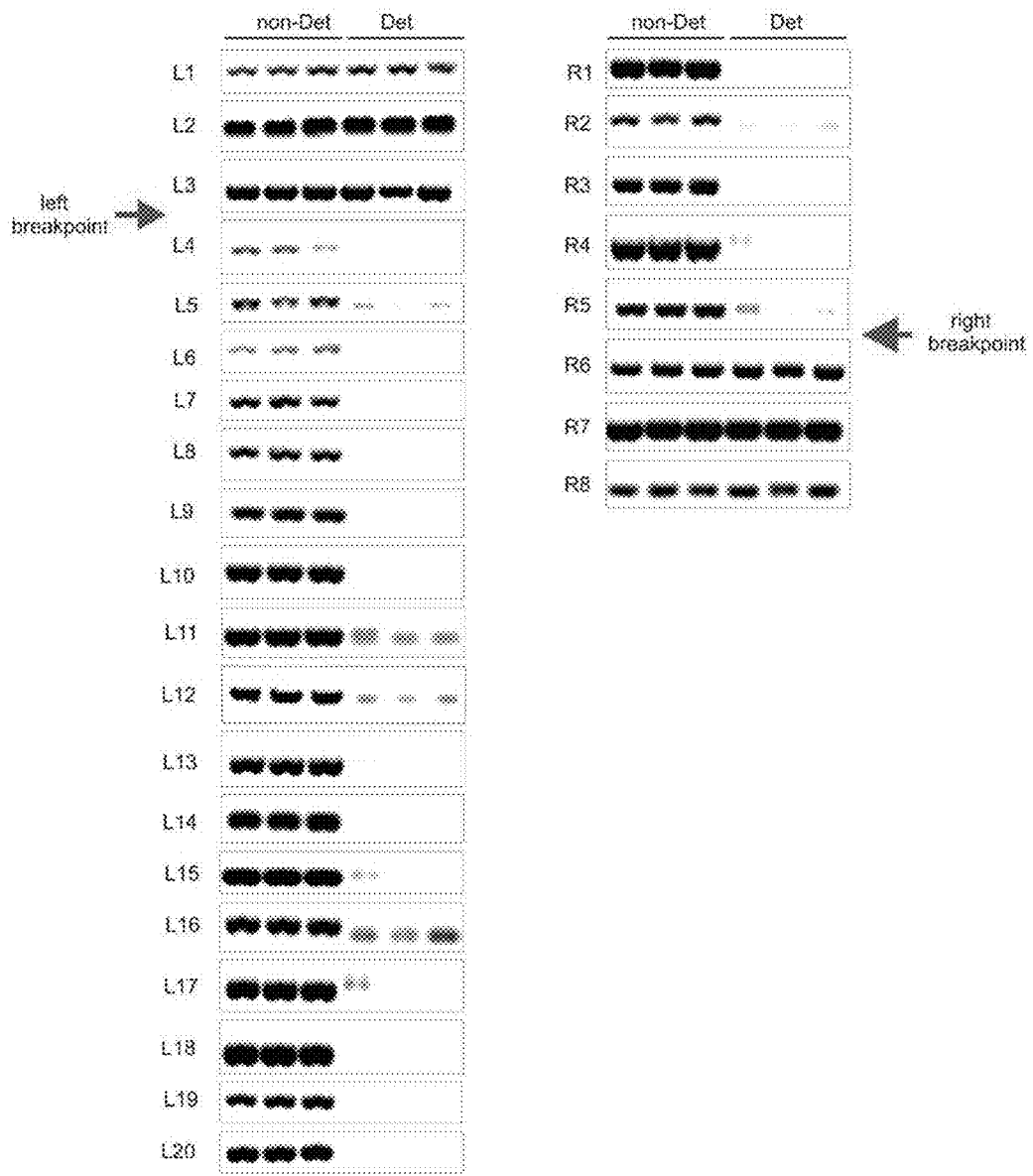

FIG. 2 shows photomicrographs obtained while mapping the deleted region by PCR amplicons. Twenty ~200 bp PCR amplicons spanning region between nucleotide 58259 to 101086 to map the left breakpoint of the deletion, eight-200 bp PCR amplicons spanning nucleotides 146591 to 153778. Red arrows mark the shift between reactions where a PCR product is evident in both determinate and non-determinate samples to the reactions where a product is evident only in the non-determinate castor samples, narrowing the breakpoints to the region between these amplicons (L3-L4, R5-R6) (Non-Det: non-determinate plants; Det: Determinate plants).

FIG. 3A shows the accurate mapping of the deletion breakpoints. Shown is the deletion breakpoint flanking region sequence as analyzed by Sanger sequencing on a PCR product prepared using primers L3-F and R6-R (SEQ ID NO: 2).

FIG. 3B shows Blast results using the sequence described in FIG. 3A as query and scaffold 30055 (SEQ ID NO: 1) as subject, done on bl2seq using standard settings www(dot)blast(dot)ncbi(dot)nlm(dot)nih(dot)gov/Blast(dot)cgi).

Figure 4:
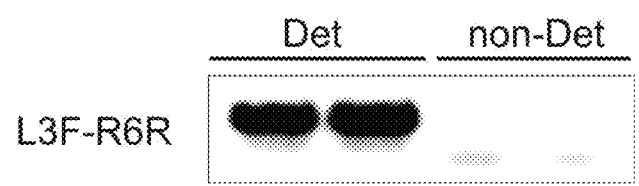

FIG. 4 is a photomicrograph showing the 381 bp PCR product amplified using primers flanking the deletion region (L3F and R6R (SEQ ID NOs: 10 and 57, respectively). The PCR product is visible on the determinate samples only.

Figure 5:
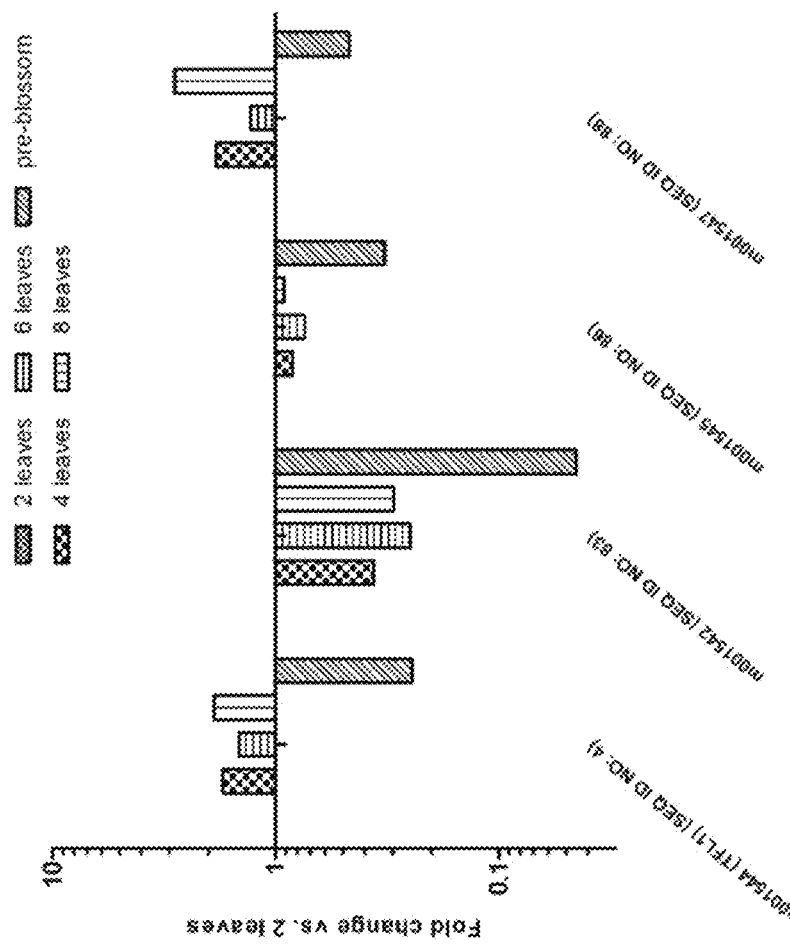

FIG. 5 is a graph showing mRNA expression level of four genes. Pre-blossom mRNA expression level versus two leaves expression was demonstrated by fold change in the non-determinate castor plant (G-10) which does not include the deletion existing in the determinate castor plant phenotype.

Figure 6A:
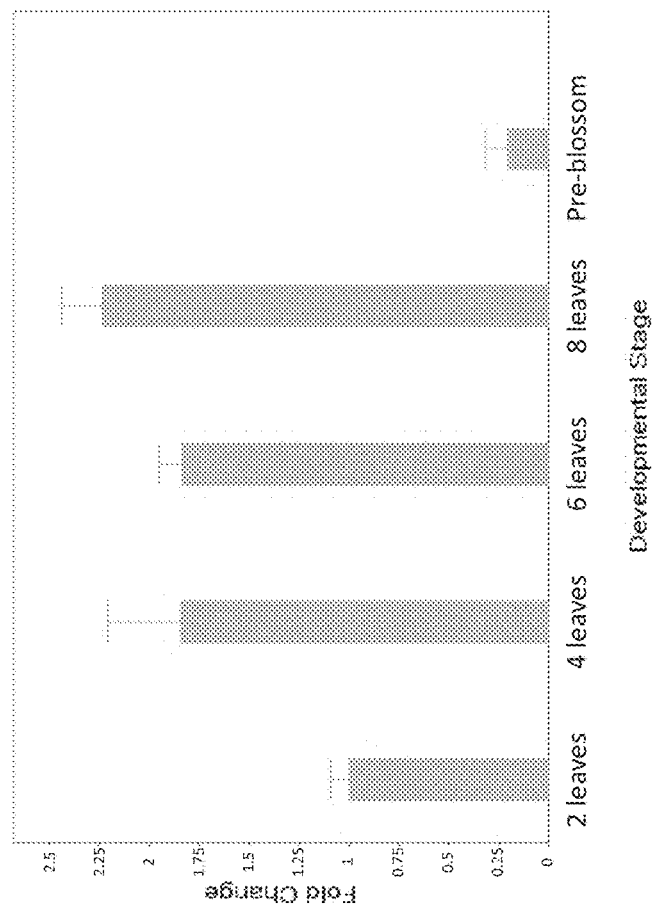
Figure 6B:
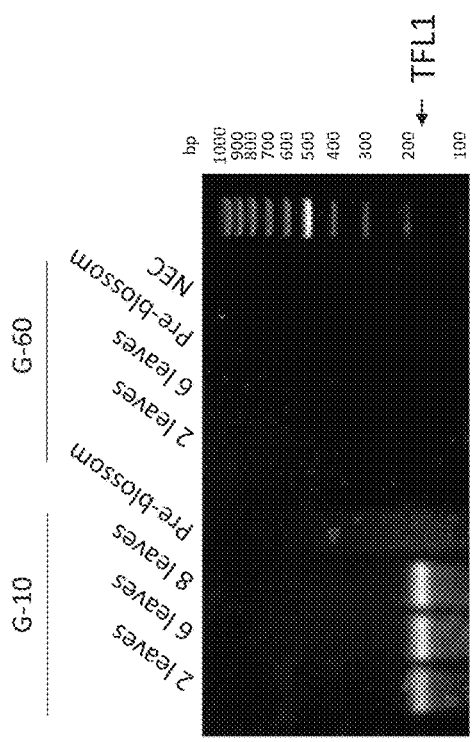

FIGS. 6A-B are graphs showing differential TFL1 mRNA expression level in 2, 4, 6 and 8 leaves and pre-blossom in the non-determinate castor plant (G-10) which does not include the deletion existing in the determinate castor plant phenotype. The results demonstrate changes in mRNA expression compared to different plant developmental stages. Major mRNA expression level effect occurred at pre-blossom stages, when TFL1 mRNA expression was dramatically downregulated.

DESCRIPTION OF SPECIFIC EMBODIMENTS OF THE INVENTION

The present invention, in some embodiments thereof, relates to determinate castor, products thereof and methods of generating same.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

*Ricinus communis*, castor plant, is a species of flowering plant in the spurge family, Euphorbiaceae. It is the sole species in the monotypic genus, *Ricinus*, and subtribe, Ricininae. Castor seed is the source of castor oil, which has a wide variety of uses. The seeds contain between 40% and 60% oil that is rich in triglycerides, mainly ricinolein. The seed also contains ricin, a water-soluble toxin, which is also present in lower concentrations throughout the plant. Castor oil has many industrial uses (e.g., biopolymers, biodiesel) as well as applications in ointments and medicine.

To allow the cultivation of castor in a modern agricultural context, the selection of new genotypes suitable for combine harvesting is desirable.

Thus, whilst reducing embodiments of the present invention to practice, the present inventors have identified through laborious screening a castor plant having a determinate phenotype. This phenotype is associated with a loss of function genotype involving a deletion of 90 Kb. Interestingly, the deletion encompasses a number of open reading frames, one of which being that of the TFL1 locus. Although, mutations in TFL-1 are generally associated with a determinate phenotype and early flowering, in plants of the Euphorbiaceae family, including prominent plants such as jatropha and castor, TFL-1 has been suggested as a flowering promoter rather than a repressor (see U.S. Patent Publication Number 20150033414).

The present findings are the first report of a determinate castor which exhibits a stable vigor for a high number of generations (e.g., above 7) and as such may be an important breeding material for the development of castor lines and castor hybrids for optimal combine harvesting and size suitable for uniform and dense planting.

As used herein the phrase "castor plant" also termed "castor oil plant" and "*Ricinus communis*" refers to the plant species of the Euphorbiaceae.

The term "plant" as used herein encompasses whole plants, ancestors and progeny of the plants and plant parts, including seeds, fruits, shoots, stems, roots (including tubers), and plant cells, tissues and organs. The plant may be in any form including callus tissue, suspension culture, embryos, meristematic regions, leaves, gametophytes, sporophytes, pollen, ovules and microspores.

The term "cultivar" is used herein to denote a plant having a biological status other than a "wild" status, which "wild" status indicates the original non-cultivated, or natural state of a plant or accession. The term "cultivar" (for cultivated variety) includes, but is not limited to, semi-natural, semi-wild, weedy, traditional cultivar, landrace, breeding material, research material, breeder's line, synthetic population, hybrid, founder stock/base population, inbred line (parent of hybrid cultivar), segregating population, mutant/genetic stock, and advanced/improved cultivar. Examples of genetic backgrounds which can be used along with the present teachings include Bright Pink, *Gibsoni*, Zanziariensis, Bright Red and Impala.

According to a specific embodiment, the castor plant is a plant line (inbred).

According to a specific embodiment, the castor plant is an elite line.

According to a specific embodiment, the castor plant is a hybrid. The castor plant of some embodiments of the present invention refers to a whole plant or portions thereof, processed or non-processed (e.g., seeds, oil, dry tissue, meal, cake etc.), regeneratable tissue culture or cells isolated therefrom.

The plant part may comprise DNA (e.g., seeds) or may be devoid of DNA (e.g., oil).

As used herein the term "determinate" refers to a determinate inflorescence.

The inflorescence of a plant is considered to be terminal or determinate when the main stem and principal branches end in a flower or inflorescence without a leaf-bud. In the determinate castor of embodiments of the invention, the vegetative parts of the plant are below the productive parts of the plant. According to a specific embodiment, no axillary branches, nor secondary branches develop.

Accordingly, the determinate phenotype arrests plant branching thus resulting in an overall less branched phenotype as compared to an indeterminate plant of the same genetic background and developmental stage.

Thus, according to an aspect of the invention, there is provided a non-genetically modified determinate castor plant.

As used herein the phrase "non-genetically modified" refers to a non-transgenic plant or a plant which is devoid of a transgene conferring the determinate habit.

According to a specific embodiment, the non-genetically modified determinate castor plant of the invention results from a spontaneous genetic event incurred by multiple crossings/selfings (see Example 1 of the Examples section which follows).

Alternatively or additionally, occurrence of the genetic event responsible for the determinate habit may be enhanced by exposing the plant or part thereof to a chemical mutagen. Examples of chemical mutagens include, but are not limited to nitrous acid, alkylating agents such as ethyl methanesulfonate (EMS), methyl methane sulfonate (MMS), diethyl-sulfate (DES), and base analogs such as 5-bromo-deoxyuridine (5BU).

The present inventors were able to associate a loss of function genetic alteration to the determinate habit.

As used herein "a loss of function genetic alteration" or a "loss of function mutation" refers to an alteration e.g., mutation, in the sequence of a gene, which causes the function of the gene product, usually a protein, to be either reduced or completely absent. A loss of function genetic alteration may be caused by an insertion or a deletion of a complete chromosome or part thereof. A loss-of-function mutation can, for instance, be caused by the truncation of the gene product because of a frameshift or nonsense mutation or by an alteration of a single or more amino acids. A phenotype associated with an allele with a loss of function mutation is usually recessive but can also be dominant.

According to a specific embodiment, the deletion is positioned on nucleic acid coordinates 60520-152129 of the 30055 scaffold (SEQ ID NO: 1).

According to a specific embodiment, the breakpoint of the deletion is defined by the sequence shown in FIG. 3A (specifically see the highlighted AC which flank the deletion).

According to a specific embodiment, the deletion is positioned on the 30055 scaffold (SEQ ID NO: 1) characterized by any or all the SNPs of Table 2 below (60520-152129). According to a specific embodiment, SNPs positions within the deletion are 101086, 110318, 123602, 129239, 146591.

According to a specific embodiment SNP 371820 (See Table 3, SEQ ID NO: 1) is an informative SNP for the deletion, polymorphic, since in the determinate samples the nucleotide is G when in a homozygous form and in the scaffold (indeterminate) the nucleotide in this position is C or C and G in a heterozygous form.

According to a specific embodiment, the deletion is flanked by primers L3-F (SEQ ID NO: 10) or R6-R (SEQ ID NO: 57). According to a specific embodiment, an amplicon of 381 bp (see FIG. 4) is evident in the determinate castor while no product is evident under the same resolution in the indeterminate plant. Other primers for detecting the deletion are primers located on: DET_DEL_2_F: 60479 (SEQ ID NO: 64); DET_DEL_2_R: 152212 (SEQ ID NO: 65); ND F: 152101 (SEQ ID NO: 66) corresponding to the 30055 coordinates.

According to a specific embodiment, the loss of function genetic alteration conferring a determinate habit is in a genetic locus selected from the group consisting of 30055.t000008 (gene and transcript, SEQ ID Nos: 67 and 79 respectively), 30055.t000009 (gene and transcript, SEQ ID Nos: 68 and 80 respectively), 30055.t000010 (gene and transcript, SEQ ID Nos: 69 and 81 respectively), 30055.t000011 (gene and transcript, SEQ ID Nos: 70 and 82 respectively), 30055.t000012 (gene and transcript, SEQ ID Nos: 71 and 83 respectively), 30055.t000013 (gene and transcript, SEQ ID Nos: 72 and 84 respectively), 30055.t000014 (gene and transcript, SEQ ID Nos: 73 and 85 respectively), 30055.t000015 (gene and transcript, SEQ ID Nos: 74 and 86 respectively), 30055.t000016 (gene and transcript, SEQ ID Nos: 75 and 87 respectively), 30055.t000017 (gene and transcript, SEQ ID Nos: 76 and 88 respectively), 30055.t000018 (gene and transcript, SEQ ID Nos: 77 and 89 respectively) and 30055.t000019 (gene and transcript, SEQ ID Nos: 78 and 90 respectively).

According to another specific region the genetic alteration is in an intergenic region within nucleic acid coordinates 60520-152129 of SEQ ID NO: 1.

According to a specific embodiment, the loss of function genetic alteration is in the TFL1 locus (TFL1 Coordinate 113916-114125 of scaffold 30055 on SEQ ID NO:1 see bold in the below Table 5: 30055.t000014).

As used herein the term "TFL1" refers to the *Arabidopsis* TERMINAL FLOWER 1 homolog of castor. Since loss of function genetic alterations and or transgenic silencing is contemplated herein, the endogenous castor variant is contemplated herein being the subject for targeting.

According to a specific embodiment, the determinate castor plant comprises a loss of function genetic alteration in both alleles of the TFL1 locus.

The term "allele" as used herein, refers to any of one or more alternative forms of a gene locus, all of which alleles relate to a trait or characteristic. In a diploid cell or organism, the two alleles of a given gene occupy corresponding loci on a pair of homologous chromosomes.

The term "gene" as used herein refers to an inherited factor that determines a biological characteristic of an organism (i.e. a melon plant), an "allele" is an individual gene in the gene pair, present in the (diploid) melon plant.

A plant is called "homozygous" for a gene when it contains the same alleles of said gene, and "heterozygous" for a gene when it contains two different alleles of said gene. The use of capital letters indicates a dominant (form of a) gene and the use of small letters denotes a recessive gene: "X,X" therefore denotes a homozygote dominant genotype for gene or property X; "X,x" and "x,X" denote heterozygote genotypes; and "x,x" denotes a homozygote recessive genotype. As commonly known, only the homozygote recessive genotype will generally provide the corresponding recessive phenotype (i.e. lead to a plant that shows the property or trait "x") whereas the heterozygotic and homozygote dominant genotypes will generally provide the corresponding dominant phenotype (i.e. lead to a plant that shows the property or trait "X"), unless other genes and/or factors such as multiple alleles, suppressors, codominance etc. (also) play a role in determining the phenotype.

As mentioned hybrids of the castor plants of the invention may be heterozygous (i.e., only one of the alleles having the loss of function mutation in the determinacy conferring locus as described hereinabove) for the determinate trait but in this case, as the inherency is recessive there won't be an apparent determinate phenotype.

It will be appreciated that determinate castor plants of the invention or hybrids thereof may be genetically modified to express a gene expression product (e.g., RNA or protein) which confers an agriculturally favorable trait e.g., biotic stress tolerance, abiotic stress tolerance, insect/nematode resistance and the like.

According to another aspect of the invention there is provided a determinate castor plant having been genetically modified to down-regulate activity or expression of TFL1 (SEQ ID NO: 3 and 4, corresponding to genomic and transcript of TFL1, respectively).

Thus, the determinate castor plant of the present invention may also be generated using other including but not limited to (a) deletion of the TFL1 (SEQ ID NO: 4) locus and alternatively or additionally other genes e.g., SEQ ID NO: 80, 81, 82, 83, 86, 88 and/or 89, (or the polypeptide sequences encodable thereby e.g., SEQ ID NO: 126, 119, 120, 121, 123, 127, 128, 124, 129, 125, 122 or 130) which are comprised in the deletion, as detailed above; (b) transcriptional inactivation of the TFL1 gene and optionally other genes which are comprised in the deletion, as detailed above (c) antisense RNA mediated inactivation of transcripts of the TFL1 gene and optionally other genes which are comprised in the deletion, as detailed above; (d) translational inactivation of transcripts of the TFL1 gene and optionally other genes which are comprised in the deletion, as detailed above; and (e) genome editing of TFL1 gene and alternatively or additionally other genes which are comprised in the deletion, as detailed above.

Below is a description of platform technologies for effecting nock-in, known-out and transcriptional silencing in plants.

Methods of introducing nucleic acid alterations to a gene of interest are well known in the art [see for example Menke D. Genesis (2013) 51:—618; Capecchi, Science (1989) 244:1288-1292; Santiago et al. Proc Natl Acad Sci USA (2008) 105:5809-5814; International Patent Application Nos. WO 2014085593, WO 2009071334 and WO 2011146121; U.S. Pat. Nos. 8,771,945, 8,586,526, 6,774, 279 and UP Patent Application Publication Nos. 20030232410, 20050026157, US20060014264; the contents of which are incorporated by reference in their entireties] and include targeted homologous recombination, site specific recombinases, PB transposases and genome editing by engineered nucleases. Agents for introducing nucleic acid alterations to a gene of interest can be designed publically available sources or obtained commercially from Transposagen, Addgene and Sangamo Biosciences.

Following is a description of various exemplary methods used to introduce nucleic acid alterations to a gene of interest and agents for implementing same that can be used according to specific embodiments of the present invention.

Genome Editing using engineered endonucleases—this approach refers to a reverse genetics method using artificially engineered nucleases to cut and create specific double-stranded breaks at a desired location(s) in the genome, which are then repaired by cellular endogenous processes such as, homology directed repair (HDR) and non-homologous end-joining (NHEJ). NHEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks in genome editing. One of skill in the art can use these naturally occurring meganucleases, however the number of such naturally occurring meganucleases is limited. To overcome this challenge, mutagenesis and high throughput screening methods have been used to create meganuclease variants that recognize unique sequences.

For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al. Nature Methods (2012) 9:073-975; U.S. Pat. Nos. 8,304,222; 8,021,867; 8,119,381; 8,124,369; 8,129,134; 8,133,697; 8,143,015; 8,143,016; 8,148,098; or 8, 163,514, the contents of each are incorporated herein by reference in their entirety. Alternatively, meganucleases with site specific cutting characteristics can be obtained using commercially available technologies e.g., Precision Biosciences' Directed Nuclease Editor™ genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., 2010; Kim et al., 1996; Li et al., 2011; Mahfouz et al., 2011; Miller et al., 2010).

Basically, ZFNs and TALENs restriction endonuclease technology utilizes a non-specific DNA cutting enzyme which is linked to a specific DNA binding domain (either a series of zinc finger domains or TALE repeats, respectively). Typically, a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012; Lee et al., 2010). In addition, when a fragment of DNA with homology to the targeted region is introduced in conjunction with the nuclease pair, the double-stranded break can be repaired via homology directed repair to generate specific modifications (Li et al., 2011; Miller et al., 2010; Urnov et al., 2005).

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins.

TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, e.g., modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al. Nature Biotechnology 2012 May; 30(5):460-5; Miller et al. Nat Biotechnol. (2011) 29: 143-148; Cermak et al. Nucleic Acids Research (2011) 39 (12): e82 and Zhang et al. Nature Biotechnology (2011) 29 (2): 149-53. A recently developed web-based program named Mojo Hand was introduced by Mayo Clinic for designing TAL and TALEN constructs for genome editing applications (can be accessed through www(dot)talendesign (dot)org). TALEN can also be designed and obtained commercially from e.g., Sangamo Biosciences™ (Richmond, Calif.).

Another agent capable of downregulating TFL1 and/or any other gene of the mentioned loci is a RNA-guided endonuclease technology e.g. CRISPR system.

As used herein, the term "CRISPR system" also known as Clustered Regularly Interspaced Short Palindromic Repeats refers collectively to transcripts and other elements involved in the expression of or directing the activity of CRISPR-associated genes, including sequences encoding a Cas9 gene (e.g. CRISPR-associated endonuclease 9), a tracr (trans-activating CRISPR) sequence (e.g. tracrRNA or an active partial tracrRNA), a tracr-mate sequence (encompassing a "direct repeat" and a tracrRNA-processed partial direct repeat) or a guide sequence (also referred to as a "spacer") including but not limited to a crRNA sequence (i.e. an endogenous bacterial RNA that confers target specificity yet requires tracrRNA to bind to Cas) or a sgRNA sequence (i.e. single guide RNA).

In some embodiments, one or more elements of a CRISPR system is derived from a type I, type II, or type III CRISPR system. In some embodiments, one or more elements of a CRISPR system (e.g. Cas) is derived from a particular organism comprising an endogenous CRISPR system, such as *Streptococcus pyogenes, Neisseria meningitides, Streptococcus thermophilus* or *Treponema denticola*.

In general, a CRISPR system is characterized by elements that promote the formation of a CRISPR complex at the site of a target sequence (also referred to as a protospacer in the context of an endogenous CRISPR system).

In the context of formation of a CRISPR complex, "target sequence" refers to a sequence to which a guide sequence (i.e. guide RNA e.g. sgRNA or crRNA) is designed to have complementarity, where hybridization between a target sequence and a guide sequence promotes the formation of a CRISPR complex. Full complementarity is not necessarily required, provided there is sufficient complementarity to cause hybridization and promote formation of a CRISPR complex. Thus, according to some embodiments, global homology to the target sequence may be of 50%, 60%, 70%, 75%, 80%, 85%, 90%, 95% or 99%. A target sequence may comprise any polynucleotide, such as DNA or RNA polynucleotides. In some embodiments, a target sequence is located in the nucleus or cytoplasm of a cell.

Thus, the CRISPR system comprises two distinct components, a guide RNA (gRNA) that hybridizes with the target sequence, and a nuclease (e.g. Type-II Cas9 protein), wherein the gRNA targets the target sequence and the nuclease (e.g. Cas9 protein) cleaves the target sequence. The guide RNA may comprise a combination of an endogenous bacterial crRNA and tracrRNA, i.e. the gRNA combines the targeting specificity of the crRNA with the scaffolding properties of the tracrRNA (required for Cas9 binding). Alternatively, the guide RNA may be a single guide RNA capable of directly binding Cas.

Typically, in the context of an endogenous CRISPR system, formation of a CRISPR complex (comprising a guide sequence hybridized to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence.

In some embodiments, the tracr sequence has sufficient complementarity to a tracr mate sequence to hybridize and participate in formation of a CRISPR complex. As with the target sequence, a complete complementarity is not needed, provided there is sufficient to be functional. In some embodiments, the tracr sequence has at least 50%, 60%, 70%, 80%, 90%, 95% or 99% of sequence complementarity along the length of the tracr mate sequence when optimally aligned.

Introducing CRISPR/Cas into a cell may be effected using one or more vectors driving expression of one or more elements of a CRISPR system such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements, may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. A single promoter may drive expression of a transcript encoding a CRISPR enzyme and one or more of the guide sequence, tracr mate sequence (optionally operably linked to the guide sequence), and a tracr sequence embedded within one or more intron sequences (e.g. each in a different intron, two or more in at least one intron, or all in a single intron).

"Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, transformed into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After transformation and positive selection, homologously targeted clones are identified. Next, a second targeting vector that contains a region of homology with the desired mutation is transformed into targeted clones, and negative selection is applied to remove the selection cassette and introduce the mutation. The final allele contains the desired mutation while eliminating unwanted exogenous sequences.

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine.

Basically, the site specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function.

Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Silencing at the transcript (RNA) level can be effected using the below exemplary platforms.

As used herein, the phrase "RNA silencing" refers to a group of regulatory mechanisms [e.g. RNA interference (RNAi), transcriptional gene silencing (TGS), post-transcriptional gene silencing (PTGS), quelling, co-suppression, and translational repression] mediated by RNA molecules which result in the inhibition or "silencing" of the expression of a corresponding protein-coding gene. RNA silencing has been observed in many types of organisms, including plants, animals, and fungi.

As used herein, the term "RNA silencing agent" refers to an RNA which is capable of specifically inhibiting or "silencing" the expression of a target gene (e.g., TFL1 and/or SEQ ID NO: 67-90). In certain embodiments, the RNA silencing agent is capable of preventing complete processing (e.g, the full translation and/or expression) of an mRNA molecule through a post-transcriptional silencing mechanism. RNA silencing agents include non-coding RNA molecules, for example RNA duplexes comprising paired strands, as well as precursor RNAs from which such small non-coding RNAs can be generated. Exemplary RNA silencing agents include dsRNAs such as siRNAs, miRNAs and shRNAs.

In one embodiment, the RNA silencing agent is capable of inducing RNA interference.

In another embodiment, the RNA silencing agent is capable of mediating translational repression.

According to an embodiment of the invention, the RNA silencing agent is specific to the target RNA (e.g., TFL1 and/or SEQ ID NO: 79-90) and does not cross inhibit or silence other targets or a splice variant which exhibits 99% or less global homology to the target gene, e.g., less than 98%, 97%, 96%, 95%, 94%, 93%, 92%, 91%, 90%, 89%, 88%, 87%, 86%, 85%, 84%, 83%, 82%, 81% global homology to the target gene; as determined by PCR, Western blot, Immunohistochemistry and/or flow cytometry.

RNA interference refers to the process of sequence-specific post-transcriptional gene silencing in animals mediated by short interfering RNAs (siRNAs).

Following is a detailed description on RNA silencing agents that can be used according to specific embodiments of the present invention.

DsRNA, siRNA and shRNA—The presence of long dsRNAs in cells stimulates the activity of a ribonuclease III enzyme referred to as dicer. Dicer is involved in the processing of the dsRNA into short pieces of dsRNA known as short interfering RNAs (siRNAs). Short interfering RNAs derived from dicer activity are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex.

Accordingly, some embodiments of the invention contemplate use of dsRNA to downregulate protein expression from mRNA.

According to one embodiment dsRNA longer than 30 bp are used. Various studies demonstrate that long dsRNAs can be used to silence gene expression without inducing the stress response or causing significant off-target effects—see for example [Strat et al., Nucleic Acids Research, 2006, Vol. 34, No. 13 3803-3810; Bhargava A et al. Brain Res. Protoc. 2004; 13:115-125; Diallo M., et al., Oligonucleotides. 2003; 13:381-392; Paddison P. J., et al., Proc. Natl Acad. Sci. USA. 2002; 99:1443-1448; Tran N., et al., FEBS Lett. 2004; 573:127-134].

According to some embodiments of the invention, dsRNA is provided in cells where the interferon pathway is not activated, see for example Billy et al., PNAS 2001, Vol 98, pages 14428-14433. and Diallo et al, Oligonucleotides, Oct. 1, 2003, 13(5): 381-392. doi:10.1089/154545703322617069.

According to an embodiment of the invention, the long dsRNA are specifically designed not to induce the interferon and PKR pathways for downregulating gene expression. For example, Shinagwa and Ishii [Genes & Dev. 17 (11): 1340-1345, 2003] have developed a vector, named pDECAP, to express long double-strand RNA from an RNA polymerase II (Pol II) promoter. Because the transcripts from pDECAP lack both the 5'-cap structure and the 3'-poly(A) tail that facilitate ds-RNA export to the cytoplasm, long ds-RNA from pDECAP does not induce the interferon response.

Another method of evading the interferon and PKR pathways in mammalian systems is by introduction of small inhibitory RNAs (siRNAs) either via transfection or endogenous expression.

The term "siRNA" refers to small inhibitory RNA duplexes (generally between 18-30 base pairs) that induce the RNA interference (RNAi) pathway. Typically, siRNAs are chemically synthesized as 21mers with a central 19 bp duplex region and symmetric 2-base 3'-overhangs on the termini, although it has been recently described that chemically synthesized RNA duplexes of 25-30 base length can have as much as a 100-fold increase in potency compared with 21mers at the same location. The observed increased potency obtained using longer RNAs in triggering RNAi is suggested to result from providing Dicer with a substrate (27mer) instead of a product (21mer) and that this improves the rate or efficiency of entry of the siRNA duplex into RISC.

It has been found that position of the 3'-overhang influences potency of a siRNA and asymmetric duplexes having a 3'-overhang on the antisense strand are generally more potent than those with the 3'-overhang on the sense strand (Rose et al., 2005). This can be attributed to asymmetrical strand loading into RISC, as the opposite efficacy patterns are observed when targeting the antisense transcript.

The strands of a double-stranded interfering RNA (e.g., an siRNA) may be connected to form a hairpin or stem-loop structure (e.g., an shRNA). Thus, as mentioned, the RNA silencing agent of some embodiments of the invention may also be a short hairpin RNA (shRNA).

The term "shRNA", as used herein, refers to an RNA agent having a stem-loop structure, comprising a first and second region of complementary sequence, the degree of complementarity and orientation of the regions being sufficient such that base pairing occurs between the regions, the first and second regions being joined by a loop region, the loop resulting from a lack of base pairing between nucleotides (or nucleotide analogs) within the loop region. The number of nucleotides in the loop is a number between and including 3 to 23, or 5 to 15, or 7 to 13, or 4 to 9, or 9 to 11. Some of the nucleotides in the loop can be involved in base-pair interactions with other nucleotides in the loop. Examples of oligonucleotide sequences that can be used to form the loop include 5'-CAAGAGA-3' and 5'-UUACAA-3' (International Patent Application Nos. WO2013126963 and WO2014107763). It will be recognized by one of skill in the art that the resulting single chain oligonucleotide forms a stem-loop or hairpin structure comprising a double-stranded region capable of interacting with the RNAi machinery.

Synthesis of RNA silencing agents suitable for use with some embodiments of the invention can be effected as follows. First, the TFL1 (or SEQ ID NO: 79-90) mRNA sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (www(dot)ambion(dot)com/techlib/tn/91/912(dot)html).

Second, potential target sites are compared to an appropriate genomic database (e.g., human, mouse, rat etc.) using any sequence alignment software, such as the BLAST software available from the NCBI server (www(dot)ncbi(dot)nlm(dot)nih(dot)gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene.

Constructs useful in the methods according to the present invention may be constructed using recombinant DNA technology well known to persons skilled in the art. The coding sequence (e.g., encoding a silencing agent to any one of SEQ ID NOs: 79-90) constructs may be inserted into vectors, which may be commercially available, suitable for transforming into plants and suitable for expression of the gene of interest in the transformed cells. The genetic construct can be an expression vector wherein the nucleic acid sequence is operably linked to one or more regulatory sequences allowing expression in the plant cells.

Plant cells may be transformed stably or transiently with the nucleic acid constructs of the present invention. In stable transformation, the nucleic acid molecule of the present invention is integrated into the plant genome and as such it represents a stable and inherited trait. In transient transformation, the nucleic acid molecule is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217.

Glass fibers or silicon carbide whisker transformation of cell cultures, embryos or callus tissue, U.S. Pat. No. 5,464, 765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

However other methods of production are also contemplated including sexual reproduction (and selection for the determinate phenotype whether morphologically or using molecular markers as described herein), tissue culture and more.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet gradually increased so that it can be grown in the natural environment.

Viruses that have been shown to be useful for the transformation of plant hosts include CaMV, TMV, TRV and BV. Transformation of plants using plant viruses is described in U.S. Pat. No. 4,855,237 (BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants, is described in WO 87/06261.

As the determinate habit is controlled by the FT/TFL1 molecular switch, the present invention also contemplates upregulation of FT in order to impart the determinant habit (e.g., upregulation of TFL1 Coordinate 113916-114125 of scaffold 30055 on SEQ ID NO:1 see bold in the below Table 5: 30055.t000014 or an ortholog having at least 70% global homology to SEQ ID NO: 1).

According to some embodiments of the present invention, the vigor of the determinate castor plant (either the genetically modified or the non-genetically modified) is stable for at least 4, 5, 7, 9 or 10 generations.

As used herein the phrase "plant vigor" refers to the amount (measured by weight) of tissue produced by the plant in a given time.

Regardless of the method used to produce the determinate castor of some embodiments of the invention, once plants or any reproductive material is at hand, it is selected from the determinate habit.

Thus, according to an aspect of the invention there is provided a method of selecting a determinate castor plant, the method comprising detecting in a genome of a castor plant a loss of function genetic alteration in a chromosomal region flanked by L3-F (SEQ ID NO: 10) and R6-R (SEQ ID NO: 57), wherein presence of a loss of function genetic alteration in said chromosomal region is indicative of a determinate castor plant.

Many methods are known in the art for analyzing for mutations including for example single base extension (SBE), allele-specific primer extension sequencing (ASPE), DNA sequencing, RNA sequencing, microarray-based analyses, universal PCR, allele specific extension, hybridization, mass spectrometry, ligation, extension-ligation, Flap Endonuclease-mediated assays, restriction fragment length polymorphism (RFLP), electrophoresis, sequence alignment, allelic specific oligonucleotide hybridization (ASO) and random amplified polymorphic DNA (RAPD).

Thus, the present invention contemplates oligonucleotides (e.g. Primers) that can be used to distinguish between the mutated and non-mutated form of TFL1. An exemplary set of primers is described in the Example section, e.g., SEQ ID NOs: 10 and 57.

Thus, once a plant carrying the loss of function genetic alteration is identified it is considered as being of a determinate habit. This plant material can be used as a breeding material in the development of castor varieties having agriculturally desired traits.

According to one embodiment, the plants of the present invention are of a hybrid variety—i.e. are generated following the crossing (i.e. mating) of two non-isogenic plants. The hybrid may be an $F_1$ Hybrid.

An "$F_1$ Hybrid" as used herein, refers to first generation progeny of the cross of two non-isogenic plants.

The development of castor hybrids of the present invention requires the development of stable parental lines while at least one of them is heterozygous to the loss of function genetic alteration as described above e.g., in the TFL1 gene. In breeding programs desirable traits from two or more germplasm sources or gene pools are combined to develop superior breeding varieties. Desirable inbred or parent lines are developed by continuous self-pollinations and/or backcrosses and selection of the best breeding lines, sometimes utilizing molecular markers to speed up the selection process.

Once the parental lines that give the best hybrid performance have been identified e.g., both carrying the loss of function genetic alteration as described above e.g., in the TFL1 gene, the hybrid seed can be produced indefinitely, as long as the homogeneity of the parents are maintained. According to one embodiment the castor plants of the present invention are stable parent plant lines (carrying the loss of function genetic alteration e.g., in the TFL1 gene in a heterozygous form).

As defined herein, the phrase "stable parental lines" refers to open pollinated, inbred lines, stable for the desired plants over cycles of self-pollination and planting. According to a specific embodiment, 95% of the genome is in a homozygous form in the parental lines of the present invention.

A common practice in plant breeding is using the method of backcrossing to develop new varieties by single trait conversion.

The phrase "single trait conversion" as used herein refers to the incorporation of new single gene into a parent line wherein essentially all of the desired morphological and physiological characteristics of the parent lines are recovered in addition to the single gene transferred.

The term "backcrossing" as used herein refers to the repeated crossing of a hybrid progeny back to one of the parental castor plants. The parental castor plant which contributes the gene for the desired characteristic is termed the non-recurrent or donor parent. This terminology refers to the fact that the non-recurrent parent is used one time in the backcross protocol and therefore does not recur. The parental castor plant to which the gene from the non-recurrent parent are transferred is known as the recurrent parent as it is used for several rounds in the backcrossing protocol.

In a typical backcross protocol, a plant from the original varieties of interest (recurrent parent) is crossed to a plant selected from second varieties (non-recurrent parent) that carries the single gene of interest to be transferred. The resulting progeny from this cross are then crossed again to the recurrent parent and the process is repeated until a castor plant is obtained wherein essentially all of the desired morphological and physiological characteristics of the recurrent parent are recovered in the converted plant, in addition to the single transferred gene from the non-recurrent parent.

Thus, near-isogenic lines (NIL) may be created by many backcrosses to produce an array of individuals that are nearly identical in genetic composition except for the trait or genomic region under interrogation in this case loss of function genetic alteration e.g., in the TFL1 gene.

Backcrossing methods can be used with the present invention to improve or introduce a characteristic into the parent lines. Marker assisted breeding (selection) as described above can be used in this method.

By implementing embodiments of the present invention, the present inventors were able to generate a determinate castor plant for which representative seeds have been deposited under the Budapest Treaty on Nov. 2, 2015 in the NCIMB Ltd. under NCIMB 42477 (VS011), NCIMB 42478 (VS018), NCIMB 42479 (VS025), NCIMB 42480 (VS030) or NCIMB 42481 (VS033).

Examples of such hybrid plants exhibiting the determinate phenotype are provided hereinbelow, Table 6.

Thus, the present invention provides novel castor plants and cultivars, and seeds and tissue culture for generating same.

Castor plants generated based on the present teachings can be further processed to generate castor plant products which are commonly used in numerous industrial applications, including bio-based lubricants, waxes, paints and coatings, plastics, medicinal, anti-fungal compounds, and cosmetics. According to a specific embodiment, the castor processed product comprises the DNA of the plant. Thus, according to an aspect of the present invention there is provided a method of producing castor oil, the method comprising: providing (e.g., by harvesting) seeds of the castor plant or plant part as described hereinabove; and extracting oil from the seeds so as to produce the castor oil.

Following is a non-limiting description of seed collection and processing.

Castor fruits are harvested when fully mature and the leaves may be dry, in about 95-180 days depending on the cultivar. Planting and harvesting may be done by hand methods or be completely mechanized (where the determinate phenotype imparts a great advantage). Harvesting should begin before rainy season in tropical regions, but in dry regions it is best to harvest when all fruits are mature.

The racemes are cut or broken-off and the capsules stripped-off and collected. Unless the capsules are dry, they must be spread out to dry quickly such as by sun drying, frost drying or by the use of defoliants. Harvesting machines may be used such as modified wheat headers which shake capsules from plants by jarring plants at their bases. Relative humidity of 45% or less is required for efficient operation with mechanical harvesters. Some indehiscent varieties are threshed by ordinary grain thresher at 400-800 r.p.m. cylinder speed. A dedicated harvesting machine may be used for the determinate phenotype. After harvesting, seeds must be removed from the capsules or hulls, usually with de-hulling machines if capsules are dry.

Percentage of seed to hull averages 55-70, depending upon the maturity of the seed at harvest and genetic background and agrotechnics and conditions.

Extraction of oil from castor seeds is done in a manner similar to that for most other oil seeds. The seeds are cleaned, cooked and dried prior to extraction. Cooking is done to coagulate protein (necessary to permit efficient extraction), and to free the oil for efficient pressing.

The first stage of oil extraction is pre-pressing, using a high pressure continuous screw press—called the expeller. Extracted oil is filtered, and the material removed from the oil is fed back into the stream along with fresh material. Material finally discharged from the press, called cake, contains 8 to 10 percent oil. It is crushed into a coarse meal, and subjected to solvent extraction with hexane or heptane.

Once the oil has been extracted from the seed, it is necessary to remove impurities from the oil. The oil is essentially a pure triglyceride, and contains almost 90% of glyceryl tricinoleate. It is the ricinoleic triglyceride that is needed in order to produce high quality castor oil.

The steps to refining the crude oil include:

Settling and Degumming of the oil—Done to remove the aqueous phase from the lipids, and to remove phospholipids from the oil.

Bleaching—Bleaching results in the removal of coloring materials, phospholipids and oxidation products.

Neutralization—The neutralization step is necessary to remove free fatty acids from the oil. This can be done in one of two ways: (a) Alkali (Chemical) or (b) Steam Stripping (Physical) means. Alkali/Chemical Method: Caustic soda (alkali) is mixed in the proper amounts and the aqueous solution is removed, leaving the neutral oil behind. Steam Stripping: This is done under vacuum, to remove moisture, free fatty acids, odor bodies, and other impurities from the oil. As it is performed under vacuum conditions, the oil can be kept at a low temperature, preserving its chemical structure by not subjecting it to temperatures in which undesirable dehydration reactions can occur.

Deodorization of the oil—Deodorization results in the removal of odour from the oil.

Many derivatives can be produced from castor oil. Some of these derivatives have chemical compositions similar to those of petroleum based oils.

Castor Seed Residue, also called Castor Meal—Castor meal is the residue obtained from castor cake solvent extraction process. It is one of the most versatile natural manures. This manure enhances the fertility of the soil without causing any damage or decay. It is enriched with the three elements vital and conducive to the proper growth of crops i.e., Nitrogen, Phosphorus and Potassium. It also has traces of nutrients like Manganese, Zinc and Copper, thus making it a balanced fertilizer. Moreover, it helps to neutralize the detrimental effects of chemical fertilizers. Apart from their contribution to nutrients, they have a number of benefits in agriculture, which none of the synthetic fertilizers or pesticides can offer. They provide slow and steady nourishment, stimulation, protection from soil nematodes and insects, improve yields, and quality of product like taste, flavor, amino acid composition etc.

The pressed cake obtained after the extraction process of castor bean often used as a fertilizer. The protein content of castor seed cake varies from 21-48% depending upon the extent of decortications. It has an ideal amino acid profile with moderately high cysteine, methionine, and isoleucine. But its anti nutritional substances, ricin, and a various allergens restrict its use in poultry feed, even at a very low level of inclusion.

Hydrogenated Castor Oil (HCO)—also known as castor wax is a hard, brittle, insoluble wax. It is produced by adding hydrogen in the presence of a nickel catalyst. It is mainly used for coatings and greases where resistance to moisture, oils and other petrochemical products is required.

HCO is produced by the hydrogenation of castor oil with nickel catalyst. Its white flakes are extremely insoluble and are water resistant. The main use is in manufacturing greases and in paper coating for food packaging.

Hydrogenated oil is also utilized in the manufacture of waxes, polishes, carbon paper, candles and crayons.

12 Hydroxy Stearic Acid (12 HSA)—12 HSA is an off-white solid fatty acid used to manufacture lithium and calcium based lubricating greases. When reacted with an ester, 12 HSA provides a hard finish for the automotive and small appliance industries.

Methyl 12 HSA (Methyl 12 Hydroxy Stearate Acid, Methyl 12 Hydroxystearate)—Methyl 12HSA is formed by direct esterification of the 12HSA with methanol. It is usually sold in the liquid form and is widely used in the continuous grease process. It has a lower melt point than 12HSA and is, therefore, easier to handle in the liquid form. Greases made with Methyl 12HSA can be formulated to higher drop points, and they experience both less bleeding and improved oxidative stability.

Blown Castor Oil—Blown castor oil is a castor oil derivative that has a higher viscosity and specific gravity than natural castor oil. These properties are induced by bubbling air thorough it at elevated temperatures. Blown castor oil finds use as a plasticizer for inks, lacquers and adhesives.

COLM, Urethane Grade—COLM (castor oil low moisture) is a refined grade of castor oil for specific applications that require minimum moisture. Typical applications include urethane coatings, adhesives and inks. COLM also finds use in urethane blowing and urethane molding.

Dehydrated oil is an excellent drying agent which compares favorably with tung oil and is used in paints and varnishes.

It is expected that during the life of a patent maturing from this application many relevant castor plant of determinate habit will be developed and the scope of the term determinate castor is intended to include all such new technologies a priori.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non-limiting fashion.

Example 1

TABLE 1

| | | Pedigree Description |
|---|---|---|
| step | season | Description |
| 1 | spring 2010 | Single plant cross: G-02 × G-01. Both inbreeds were non-determinate. |
| 2 | fall 2010 | Six plants of G-03 F1 population were self-pollinated, and bulk seeds from all six plants were collected to establish F2 population G-04. |
| 3 | spring 2011 | All 250 plants of F2 population G-04 were non-determinate! All plants were self-pollinated and four plants were selected for F3 for their potential yield. |
| 4 | fall 2011 | F3 population G-05 showed one determinate plant out of 25 plants. The determinate naturally mutant was bagged and self-pollinated. 15 seeds were collected while only 11 germinated. |
| 5 | spring 2012 | All 11 plants in population G-06 were determinate plants, implying on the recessive nature of the mutation. |
| 6 | spring 2012 | Pollen was collected from all 11 plant of determinate G-06, to serve a male for crosses with G-07 to G-15. Nine crosses were successful, and F1 seeds were collected from them. |
| * | fall 2012 until today | All descendants of future generations of G-06 maintained their determinate nature. |
| 7 | fall 2012 | All 6 plants from all 26 F1 populations using G-06 pollen (G-25-G-33) have showed no determinate nature, proving the recessive nature of the mutation. All plants were self-pollinated and F2 bulk of seeds was collected from every F1 population. |
| 8 | spring 2013 | 250 seeds of each F2 population (G-34-G-42) were planted. All G-34-G-42 F2 populations were segregating for determinate plants. Some determinate plants were selected for F3 generation. |
| 9 | fall 2013-spring 2015 | Four more cycles of selections on the determinate progenies originated in F2 population G-34 to G-42 were done, and F6 populations were established in spring 2015. Those 16 determinate populations (G43-G58) were phenotyped in order to demonstrate a fixed determinate trait along with high variations of other typical castor phenotypes. |

TABLE 1-continued

Pedigree Description

| step | season | Description |
|---|---|---|
| 10 | Fall 2013-fall 2014 | A cross between G-59 × G-60 (AKA 502 × 593) was made to establish G-61 F1 population (AKA 504), as the basis for GBS population G-62 (AKA 505) |
| 11 | spring 2015 | Crosse between two determinate parents were made in order to establish 5 determinate F1 hybrids G-63 to G-67. All plants in those five hybrids were determinate, along with high variations of other typical castor phenotypes. Seeds from G-63 to G-67 were deposited in location NCIMB Ltd. Aberdeen, Scotland at date Nov. $2^{nd}$, 2015 |

Example 2

Mapping of the Determinate Locus

In order to associate the phenotypic trait of the determinate plant with the genomic event, a GBS/RAD analysis was performed.

Restriction-site Associated DNA (RAD) relates to the restriction endonuclease recognition sites associated DNA method which reduces the complexity of the genome. In the absence of a reference genome, this technology identifies SNP sites, such that a high-density genetic map may be constructed. This map can be used for QTL mapping.

A total of 150 plant samples were collected from parental line, namely 502 and 503 (see Table 3, below) and their F2 segregated population derived from crossing the above mentioned parental lines (see Table 3, below). High quality DNA was prepared from each collected sample as follows: 150 mg tissue was weighed, frozen in liquid nitrogen and crushed using a mortar and pestle. Samples were then resuspended in 750 μl CTAB lysis buffer [300 mM Tris-HCl pH 8.0, 25 mM EDTA pH 8.0, 2 M NaCl, 2% (w/v) soluble PVP (MW 40000), 2% (w/v) CTAB], added with 5 μl RNAseA [3.3 mg/ml], vortexed and incubated 30 minutes in a 65° C. water bath. Samples were then cooled to room temperature and added with 750 μl Chloroform-isoamylalcohol (24:1, v/v).

After gentle shaking of the tubes for 5 minutes, the samples were centrifuged, 14,000 RPM for 15 min. Upper phase was transferred to a clean tube added with 650 ill of isopropanol 100% and incubated in a −20° C. freezer for 2 hr after which DNA was pelleted by centrifuging, 14,000 RPM, for 15 min. The pellet was washed with 70% pre chilled ethanol (EtOH) and resuspended in 120 μl TE buffer.

Following DNA preparation, samples were quantified using the Qubit HS assay (Life Technologies) and run on a gel to verify the DNA was not degraded in the process. Ninety six samples of a segregating F2 population were selected according to the phenotypic representation in the field. This F2 population segregated to non-determinate and determinate plants. Some determinate and non-determinate were selected, while some of the non-determinate were homozygous and some were heterozygous. DNA was sequences by BGI, China.

DNA was sequenced on an Illumina Hiseq 2000 machine producing paired-end 91 bp data. Sequencing raw data was checked for QC using FASTQC, filtered and assigned for samples according to the barcode linked to each sample. Samples were aligned using SOAP. SAMTOOLS was then used to call SNP variation on each on the aligned tags. SNP analysis detected between 42926 to 60876 SNP markers compared to the castor genome draft with approximately 5000 of them showing heterozygosity between parental lines.

Once genotypic data was obtained for 88 samples and 2 samples from each parental samples (namely 502 and 503), the file type was converted from genotypes to a hapmap format. 1,657 hapmap files were constructed for all available scaffolds in the castor genome. Each file consisted of all available markers within the scaffold, and the genotypes identified in all the samples that were sequenced. The Tassel software tool was used to perform association testing of the determinate trait between all available samples. All 1,657 hapmap files were loaded into the tassel database together with trait table holding phenotype information. Scaffold information was merged together to one genotype table for all the castor genome. Association analysis was done using the General Linear Model (GLM) statistical approach and was further tested for a possible randomization effect using a permutation test of 1,000 permutations. Results were then filtered by the strictest association: P values that are supported by the smallest possible permutation (p value in this case of 0.001).

Table 2 below shows the highest scoring markers associated with the castor determinate trait. The deleted region in the determinate castor plant comprise 12 coding genes annotated as described in Table 5 below.

TABLE 2

Output table of SNP markers found by tassel to be associated with the determinate trait:

| SNP no: | Marker | Locus | Locus_pos | marker_F | marker_p | perm_p |
|---|---|---|---|---|---|---|
| 1 | S0_123602 | 30055 | 123602 | 528.6743295 | 5.70E−39 | 0.001 |
| 2 | S0_146591 | 30055 | 146591 | 261.3645488 | 1.64E−37 | 0.001 |
| 3 | S0_371820 | 30055 | 371820 | 131.2403641 | 5.40E−32 | 0.001 |
| 4 | S0_129239 | 30055 | 129239 | 122.324075 | 5.24E−26 | 0.001 |
| 5 | S0_101086 | 30055 | 101086 | 87.91952339 | 1.30E−21 | 0.001 |

TABLE 2-continued

Output table of SNP markers found by tassel
to be associated with the determinate trait:

| | | | | | | |
|---|---|---|---|---|---|---|
| 6 | S0__352240 | 29589 | 352240 | 54.56872912 | 7.55E-20 | 0.001 |
| 7 | S0__194781 | 29638 | 194781 | 47.99356213 | 2.54E-18 | 0.001 |
| 8 | S0__83123 | 29589 | 83123 | 45.85323966 | 8.51E-18 | 0.001 |
| 9 | S0__83186 | 29589 | 83186 | 45.85323966 | 8.51E-18 | 0.001 |
| 10 | S0__157519 | 29638 | 157519 | 46.96400398 | 1.47E-14 | 0.001 |
| 11 | S0__157501 | 29638 | 157501 | 46.96400398 | 1.47E-14 | 0.001 |

| SNP no: | markerR2 | markerDF | markerMS | errorDF | errorMS | modelDF | modelMS |
|---|---|---|---|---|---|---|---|
| 1 | 0.857299 | 1 | 17.14598 | 88 | 0.032432 | 1 | 17.14598 |
| 2 | 0.857314 | 2 | 8.573137 | 87 | 0.032801 | 2 | 8.573137 |
| 3 | 0.820729 | 3 | 5.471528 | 86 | 0.041691 | 3 | 5.471528 |
| 4 | 0.737674 | 2 | 7.376738 | 87 | 0.060305 | 2 | 7.376738 |
| 5 | 0.668999 | 2 | 6.68999 | 87 | 0.076092 | 2 | 6.68999 |
| 6 | 0.655595 | 3 | 4.370635 | 86 | 0.080094 | 3 | 4.370635 |
| 7 | 0.626056 | 3 | 4.173704 | 86 | 0.086964 | 3 | 4.173704 |
| 8 | 0.615315 | 3 | 4.102102 | 86 | 0.089462 | 3 | 4.102102 |
| 9 | 0.615315 | 3 | 4.102102 | 86 | 0.089462 | 3 | 4.102102 |
| 10 | 0.519146 | 2 | 5.191458 | 87 | 0.110541 | 2 | 5.191458 |
| 11 | 0.519146 | 2 | 5.191458 | 87 | 0.110541 | 2 | 5.191458 |

Example 3

Mapping the Causal Mutation for Determinate Castor

Examining the SNP calls from GBS data set (see Table 3, below), it is evident that the plants showing a determinate phenotype were missing the SNPs from markers 1-2 and 4-5 (see Table 2, above), which led to the hypothesis that the determinate phenotype is caused by a genomic deletion in the region (scaffold 30055, nucleotides 101086-146591, SEQ ID NO: 1) with the exact breakpoints located between the markers present both in the determinate and non-determinate samples and the markers present only in the non-determinate samples, namely, left breakpoint: 58259-101086 and the right deletion breakpoint: 146591-153778. To map the deletion area efficiently, primers were designed to amplify specific small PCR products, covering the suspected breakpoint region and by intervals of 2000-5000 bp (see FIG. 1). FIG. 2 shows amplicons L1-L3 (see Table 4 below) are positive both in the determinate and non-determinate samples while L4-L20 (see Table 4) amplicons are missing in the non-determinate samples restricting the left breakpoint to 60494-61345 and amplicons R6-R8 (see Table 4, below) positive on both determinate and non-determinate while R1-R5 (see Table 4, below) positive only in the non-determinate samples restricting the right deletion break point to 15226-151623. Primers used for the mapping amplicons are described on Table 4, below. To further map the exact breakpoint a primers L3-F (SEQ ID NO: 10) and L6-R (SEQ ID NO: 57) were used to amplify the breakpoint region which was then Sanger sequenced. The resulting sequence (FIG. 3A, SEQ ID NO: 2) was aligned to the castor genome (FIG. 3B), mapping the exact deletion break points to coordinates 60520-152129 on the 30055 scaffold sequence (SEQ ID NO: 1).

Example 4

Castor TFL1 Homolog is Located within the Associated Determinate Deleted Region

Gene annotation for the 30055: 60520-152129 deleted region found 12 genes mapped within (described on Table 5, below). Locus ID: 30055.t000014 was found to be homologous to a conserved family of proteins involved in flowering regulation. 30055.t000014 included missing nucleotides on the published draft. In order to sequence the complete transcript, the gene was amplified and sequenced using primers TFL1_30055_F CAAAAGTTCACAAGCCAT-GAG (SEQ ID NO: 62) and TFL1_30055_R TTCTC-CCAACAAGGCAGAAG (SEQ ID NO: 63), the resulting sequence (polynucleotide SEQ ID NO: 3; CDS SEQ ID NO: 4 and deduced protein sequence SEQ ID NO: 5) is found to be highly homologous to TFL1.

TABLE 3

Markers and associations derived from the GBS data

| | | | | | | | scaffold 30055 Loci | | | | | | | |
|---|---|---|---|---|---|---|---|---|---|---|---|---|---|---|
| phe-no-type | REF | 2882 C | 31423 C | 31424 A | 58259 A | 101086 G | 110318 A | 123602 G | 129239 C | 146591 G | 153778 C | 153779 C | 164816 G | 164818 T | 371820 C |
| D | F2505-101 | — | A | — | C | — | — | — | — | — | C | C | G | T | G |
| D | F2505-104 | G | A | — | C | — | — | — | — | — | C | C | G | T | G |
| D | F2505-10 | G | A | G | C | — | — | — | — | — | Y | C | G | T | G |
| D | F2505-113 | — | — | — | C | — | — | — | — | — | — | — | G | T | G |
| D | F2505-114 | — | — | — | C | — | — | — | — | — | — | C | G | T | G |
| D | F2505-116 | G | — | — | C | — | — | — | — | — | C | C | G | T | G |
| D | F2505-11 | G | A | G | C | — | — | — | — | — | C | C | G | T | G |

TABLE 3-continued

Markers and associations derived from the GBS data

| phe-no-type | REF | 2882 C | 31423 C | 31424 A | 58259 A | 101086 G | 110318 A | 123602 G | 129239 C | 146591 G | scaffold 30055 Loci 153778 C | 153779 C | 164816 G | 164818 T | 371820 C |
|---|---|---|---|---|---|---|---|---|---|---|---|---|---|---|---|
| D | F2505-122 | G | — | — | C | — | — | — | — | — | M | C | G | T | G |
| D | F2505-144 | — | — | — | — | — | — | — | — | — | — | — | G | T | — |
| D | F2505-148 | G | — | — | — | — | — | — | — | — | C | C | G | T | G |
| D | F2505-16 | G | A | G | C | — | — | — | — | — | C | C | G | T | G |
| D | F2505-176 | G | — | — | C | — | — | — | — | — | C | C | G | T | G |
| D | F2505-17 | G | A | G | C | — | — | — | — | — | — | — | R | T | G |
| D | F2505-23 | — | A | G | C | — | — | — | — | — | M | C | G | T | G |
| D | F2505-35 | G | A | G | C | — | — | — | — | — | Y | Y | G | T | G |
| D | F2505-46 | G | A | G | C | — | — | — | — | — | Y | M | R | T | G |
| D | F2505-4 | G | A | G | C | — | — | — | — | — | C | C | G | T | G |
| D | F2505-50 | G | A | G | C | — | — | — | — | — | M | S | G | T | G |
| D | F2505-53 | G | A | G | C | — | — | — | — | — | — | — | R | T | G |
| D | F2505-55 | G | A | G | C | — | — | — | — | — | C | C | G | T | G |
| D | F2505-58 | G | A | — | C | — | — | — | — | — | C | C | G | T | G |
| D | F2505-61 | G | A | G | C | — | — | — | — | — | C | C | R | T | G |
| D | F2505-67 | G | A | G | C | — | — | — | — | — | C | C | G | T | G |
| D | F2505-68 | G | A | G | C | — | — | — | — | — | Y | C | G | T | G |
| D | F2505-71 | G | A | — | — | — | — | — | — | — | — | — | G | T | G |
| D | F2505-73 | G | A | — | C | — | — | — | — | — | S | Y | G | T | G |
| D | F2505-85 | G | A | — | C | — | — | — | — | — | C | C | G | T | G |
| D | F2505-92 | G | A | — | C | — | — | — | — | — | C | C | G | T | G |
| D | F2505-95 | — | A | — | — | — | — | — | — | — | C | C | — | — | G |
| D | P503-4 | G | A | G | C | — | — | — | — | — | C | C | G | T | G |
| D | P503-5 | G | A | G | C | — | — | — | — | — | C | C | G | T | G |
| D/+ | F2505-165 | G | — | — | C | A | G | G | C | G | C | C | G | T | S |
| N-D | F2505-103 | G | A | — | C | A | G | G | C | G | — | C | G | T | — |
| N-D | F2505-106 | G | A | — | C | A | G | G | C | G | C | C | R | T | S |
| N-D | F2505-110 | — | A | — | C | A | G | G | C | G | Y | C | G | T | S |
| N-D | F2505-111 | G | A | — | C | A | G | G | C | G | C | C | G | T | S |
| N-D | F2505-117 | G | — | — | C | A | G | G | C | G | Y | C | R | T | S |
| N-D | F2505-12 | — | A | G | — | A | G | G | C | G | C | C | G | T | C |
| N-D | F2505-134 | — | G | A | — | A | — | G | C | G | — | — | G | T | C |
| N-D | F2505-141 | — | — | — | C | — | — | G | C | G | — | — | G | T | S |
| N-D | F2505-145 | — | — | — | C | — | — | G | C | G | — | — | — | — | G |
| N-D | F2505-146 | G | — | — | C | A | G | G | C | G | Y | Y | G | T | S |
| N-D | F2505-149 | G | — | — | C | A | G | G | C | G | C | C | G | T | S |
| N-D | F2505-14 | — | A | G | C | A | — | G | C | G | — | — | G | T | S |
| N-D | F2505-157 | G | — | — | C | A | G | G | C | G | M | C | G | T | S |
| N-D | F2505-15 | G | A | G | C | A | G | G | C | G | C | C | G | T | S |
| N-D | F2505-163 | G | — | — | C | A | G | G | C | G | C | C | R | T | C |
| N-D | F2505-171 | — | — | — | C | A | G | G | C | G | — | — | — | — | C |
| N-D | F2505-183 | — | — | — | C | A | G | G | C | G | Y | C | G | T | C |
| N-D | F2505-18 | G | A | G | C | A | G | G | C | G | C | C | G | T | S |
| N-D | F2505-1 | G | — | — | C | A | G | G | C | G | C | C | G | T | S |
| N-D | F2505-20 | G | A | G | C | A | G | G | Y | G | Y | M | G | T | C |
| N-D | F2505-21 | — | A | G | C | A | G | G | C | G | C | C | G | T | S |
| N-D | F2505-22 | G | A | G | C | A | — | G | C | G | C | C | G | T | S |
| N-D | F2505-25 | — | A | G | C | A | — | G | C | K | C | — | G | T | S |
| N-D | F2505-26 | G | A | G | C | A | G | G | C | G | C | C | G | T | S |
| N-D | F2505-27 | G | A | G | — | A | — | G | C | G | C | S | G | T | C |
| N-D | F2505-29 | G | A | G | C | A | G | G | C | G | C | C | G | T | C |
| N-D | F2505-2 | G | A | G | — | A | G | G | C | G | — | — | G | T | C |
| N-D | F2505-30 | G | A | G | C | A | G | G | C | G | C | C | G | T | C |
| N-D | F2505-31 | G | A | G | C | A | — | G | C | G | C | C | G | T | C |
| N-D | F2505-37 | G | A | G | C | A | — | G | C | G | C | C | G | T | S |
| N-D | F2505-38 | G | A | G | C | A | G | G | C | G | C | C | G | T | C |
| N-D | F2505-40 | G | A | G | C | A | G | G | C | G | M | M | G | T | S |
| N-D | F2505-41 | G | A | G | C | A | G | G | C | G | M | C | G | T | S |
| N-D | F2505-42 | G | A | G | C | A | G | G | C | G | M | S | G | T | S |
| N-D | F2505-43 | G | A | G | C | A | G | G | C | G | C | C | R | T | S |
| N-D | F2505-45 | G | A | G | C | A | G | G | C | G | — | — | R | T | C |
| N-D | F2505-47 | G | A | G | C | A | — | G | C | G | — | — | G | T | G |
| N-D | F2505-48 | G | A | G | C | A | G | G | C | G | — | C | R | T | C |
| N-D | F2505-49 | G | A | G | C | A | G | G | C | G | C | C | G | T | S |
| N-D | F2505-51 | G | A | G | C | A | G | G | C | G | Y | C | G | T | C |
| N-D | F2505-52 | G | A | G | C | A | G | G | C | G | Y | Y | G | W | C |
| N-D | F2505-54 | G | W | R | C | — | — | G | C | G | C | C | G | T | S |
| N-D | F2505-56 | G | A | G | C | A | G | G | C | G | C | C | G | T | C |
| N-D | F2505-59 | G | A | G | C | A | G | G | C | G | C | C | G | T | C |
| N-D | F2505-5 | G | A | G | C | A | — | G | C | G | — | — | G | T | C |
| N-D | F2505-63 | G | A | G | C | A | — | G | C | G | C | C | G | T | S |

TABLE 3-continued

Markers and associations derived from the GBS data

| phenotype | REF | scaffold 30055 Loci | | | | | | | | | | | | | |
|---|---|---|---|---|---|---|---|---|---|---|---|---|---|---|---|
| | | 2882 C | 31423 C | 31424 A | 58259 A | 101086 G | 110318 A | 123602 G | 129239 C | 146591 G | 153778 C | 153779 C | 164816 G | 164818 T | 371820 C |
| N-D | F2505-69 | G | A | G | C | A | G | G | C | G | Y | M | G | T | S |
| N-D | F2505-6 | G | A | G | C | A | G | G | C | G | C | C | G | T | S |
| N-D | F2505-72 | C | A | — | M | R | R | G | C | G | — | — | R | T | C |
| N-D | F2505-77 | — | A | A | C | — | G | G | C | G | — | — | G | T | C |
| N-D | F2505-78 | G | A | — | C | A | G | G | C | G | Y | S | G | T | S |
| N-D | F2505-80 | G | — | — | — | A | G | G | C | G | C | C | G | T | S |
| N-D | F2505-81 | G | A | — | C | A | — | G | C | G | C | C | G | T | S |
| N-D | F2505-82 | — | A | — | C | — | — | G | — | G | — | — | G | T | S |
| N-D | F2505-86 | — | A | — | C | A | G | G | C | G | — | — | G | T | C |
| N-D | F2505-87 | — | A | A | C | A | G | G | C | G | — | — | G | T | C |
| N-D | F2505-88 | G | A | — | C | A | G | G | C | G | M | C | R | T | C |
| N-D | F2505-96 | G | A | — | C | A | G | G | C | G | C | — | G | T | C |
| N-D | P502-2 | G | A | G | C | A | G | G | C | G | — | — | G | T | C |
| N-D | P502-3 | G | A | G | C | A | G | G | C | G | C | C | G | T | C |

S = according IUPAC nucleotide code is G or C.

TABLE 4

Primers used for mapping of breakpoints

| name | SEQ ID NO: | sequence 5'-3' |
|---|---|---|
| L1-F | 6 | TACTCCCACAAGGCCACAAC |
| L1-R | 7 | TGGAGTTGGCTTGTTTCTTGAG |
| L2-F | 8 | ACTCGATGGCTTGCTCTTTG |
| L2-R | 9 | TTCACATGCGCTCTTCTGTC |
| L3-F | 10 | AGTGATTAAGGCATGTCACTGT |
| L3-R | 11 | ACCAATGAATTTGCAAATAAATAGCA |
| L4-F | 12 | AATAGTGGGCTCGGGTTTTCTC |
| L4-R | 13 | TCTTTTCTCCGCCGCTTTTC |
| L5-F | 14 | TGGAAAAGTCAAATGCCTCCTG |
| L5-R | 15 | AATCGACAGGAGACACGAAGC |
| L6-F | 16 | TCTCTGCGTGAACAATTGCG |
| L6-R | 17 | TGAAGGCGAGTTTTGCGTTG |
| L7-F | 18 | CCTGAAGAGAGCCAACCAAC |
| L7-R | 19 | GCAACAGGGCTACAATTTGC |
| L8-F | 20 | TCCCATAAGAGAGGCTTTTCTTG |
| L8-R | 21 | TGGAAGAGTCAACTTTGGAATCC |
| L9-F | 22 | TCCAAGATCCGTACAGTCCATG |
| L9-R | 23 | AATCAGTAGCCCGGTTGATGG |
| L10-F | 24 | AGGCCGAATTGCACACTTTC |
| L10-R | 25 | TGGCAGAATGTCCAACAACC |
| L11-F | 26 | AAGGCCATAGCACTCGAAAC |
| L11-R | 27 | GGAAATGAGTTTGAGCCATGGG |
| L12-F | 28 | GGACTAGCCTATGGTCATTTTCC |
| L12-R | 29 | ATAGCATGGGCCAAAATGGG |
| L13-F | 30 | ATGCCTGGTGCTGTAAATGG |
| L13-R | 31 | TGCAAAAACTCCCTGTCTCC |
| L14-F | 32 | CCCCCAACTTGCTTTCTTCC |
| L14-R | 33 | TGAGGTCTCTTCCATTCCATCC |
| L15-F | 34 | GCAGAGAAGATCATGGAACTCG |
| L15-R | 35 | GCCATCTCTCCCTGCATTTTC |
| L16-F | 36 | TCTGTGGGTCTTTGGTTTGAG |
| L16-R | 37 | AAATCGAGGATGACCCACACC |
| L17-F | 38 | TGCATCTGGCTCAAGTTTTGG |
| L17-R | 39 | AAAAGGCCGTCGAATGAAGC |
| L18-F | 40 | CAACCTGGAGAATTTGACAGTTG |
| L18-R | 41 | AAGCCAGCAGAGCAAATGAG |
| L19-F | 42 | GGCAATGGCACTTTCAATTGC |
| L19-R | 43 | AAAAGGTGGTGGGACTTGTG |
| L20-F | 44 | ACCGCAACTCCTCATTTTCC |
| L20-R | 45 | ATCGGGTCTTTCAACAGCAC |
| R1-F | 46 | AATGATGACACTGCGTGGTC |
| R1-R | 47 | AAACCCCATCGAAACAGTGC |
| R2-F | 48 | TTTTTCACATCGCGCACCAG |
| R2-R | 49 | TCAAGCGCAGATCAAACCTG |
| R3-F | 50 | AAACCTTGCCTCAAGACAGC |
| R3-R | 51 | TCAAACCGAACAGTACCTCCAC |

TABLE 4 -continued

Primers used for mapping of breakpoints

| name | SEQ ID NO: | sequence 5'-3' |
|---|---|---|
| R4-F | 52 | AAGCTGCGATCTTGCGATAC |
| R4-R | 53 | GCAGTTATAAACAGGTTCTGAGC |
| R5-F | 54 | CCTTTGTTCTTGGCCGTGTATC |
| R5-R | 55 | AACAATGGCCGAGTCAACAG |
| R6-F | 56 | TCGCAGGTCAAAATCTTCCC |
| R6-R | 57 | TCATTCCTGAGCACTGTACTGG |
| R7-F | 58 | ACCAGTACAGTGCTCAGGAATG |
| R7-R | 59 | CCTTTTGTCACAGCCTTCTGC |
| R8-F | 60 | GAAAGTGAGGAATCAGGTGCTG |
| R8-R | 61 | TTAGAGCAACCTCGCCACTG |

TABLE 5

Genes located within the deleted region and their annotations:

| Locus Name | Gene and transcript Name/SEQ ID Nos: respectively | Location | Description | annotation accession no: | database | annotation |
|---|---|---|---|---|---|---|
| 30055.t000008 | 30055.m001538 (primary) (SEQ ID NOs: 67 and 79) | 30055: 61367 . . . 64067 forward | conserved hypothetical protein | | | homologous to *Theobroma cacao*, S-adenosyl-L-methionine-dependent methyltransferases superfamily protein (68% P) |
| 30055.t000009 | 30055.m001539 (primary) (SEQ ID NOs: 68 and 80) | 30055: 65043 . . . 66139 forward | zinc finger protein, putative | PTHR10634 | PANTHER | AN1-TYPE ZINC FINGER PROTEIN |
| | | | | PF01428 | PFAM | AN1-like Zinc finger |
| | | | | PF01754 | PFAM | A20-like zinc finger |
| | | | | KOG3173 | KOG | Predicted Zn-finger protein |
| | | | | GO:0003677 | GO | DNA binding |
| | | | | GO:0008270 | GO | zinc ion binding |
| 30055.t000010 | 30055.m001540 (primary) (SEQ ID NOs: 69 and 81) | 30055: 73235 . . . 74539 forward | sialyltransferase, putative | PTHR13713 | PANTHER | SIALYLTRANSFERASE |
| | | | | PTHR13713: SF31 | PANTHER | |
| | | | | PF00777 | PFAM | Glycosyltransferase family 29 (sialyltransferase) |
| | | | | KOG2692 | KOG | Sialyltransferase |
| | | | | GO:0006486 | GO | protein glycosylation |
| | | | | GO:0008373 | GO | sialyltransferase activity |
| 30055.t000011 | 30055.m001541 (primary) (SEQ ID NOs: 70 and 82) | 30055: 76060 . . . 80046 reverse | poly [ADP-ribose] polymerase, putative | PTHR15447 | PANTHER | POLY [ADP-RIBOSE] POLYMERASE |
| | | | | PF00533 | PFAM | BRCA1 C Terminus (BRCT) domain |
| | | | | PF00644 | PFAM | Poly(ADP-ribose) polymerase catalytic domain |
| | | | | PF02877 | PFAM | Poly(ADP-ribose) polymerase, regulatory domain |
| | | | | PF05406 | PFAM | WGR domain |
| | | | | PF08063 | PFAM | PADR1 (NUC008) domain |
| | | | | KOG1037 | KOG | NAD+ ADP-ribosyltransferase Parp, required for poly-ADP ribosylation of nuclear proteins |
| | | | | GO:0003950 | GO | NAD+ ADP-ribosyltransferase activity |
| | | | | GO:0005634 | GO | nucleus |
| | | | | GO:0006471 | GO | protein ADP-ribosylation |
| 30055.t000012 | 30055.m001542 (primary) (SEQ ID NO: 71 and 83) | 30055: 87039 . . . 89772 reverse | TRANSPARENT TESTA 1 protein, putative | PTHR10593 | PANTHER | SERINE/THREONINE-PROTEIN KINASE RIO |
| | | | | PTHR10593: SF10 | PANTHER | ATM INTERACTOR (ATM/ATR-SUBSTRATE CHK2-INTERACTING ZINC FINGER PROTEIN) |
| | | | | GO:0003676 | GO | nucleic acid binding |
| | | | | GO:0046872 | GO | metal ion binding |

TABLE 5-continued

Genes located within the deleted region and their annotations:

| Locus Name | Gene and transcript Name/SEQ ID Nos: respectively | Location | Description | annotation accession no: | database | annotation |
|---|---|---|---|---|---|---|
| 30055.t000013 | 30055.m001543 (primary) (SEQ ID NO: 72 and 84) | 30055: 100857 . . . 106034 forward | bile acid: sodium symporter, putative | PTHR18640 | PANTHER | FAMILY NOT NAMED |
| | | | | PTHR18640: SF1 | PANTHER | GB DBF: HYPOTHETICAL PROTEIN F18O21_120 |
| | | | | PF01758 | PFAM | Sodium Bile acid symporter family |
| | | | | KOG4821 | KOG | Predicted Na+-dependent cotransporter |
| | | | | GO:0016020 | GO | membrane |
| | | | | GO:0006814 | GO | sodium ion transport |
| | | | | GO:0008508 | GO | bile acid: sodium symporter activity |
| | | | | K14347 | KEGGORTH | |
| 30055.t000014 | 30055.m001544 (primary) (SEQ ID NO: 73 and 85) | 30055: 113916 . . . 114125 reverse | phosphatidyl-ethanolamine-binding protein, putative | PTHR11362 | PANTHER | PHOSPHATIDYLETHANOL-AMINE-BINDING PROTEIN |
| | | | | PF01161 | PFAM | Phosphatidylethanolamine-binding protein |
| 30055.t000015 | 30055.m001545 (primary) (SEQ ID NO: 74 and 86) | 30055: 122797 . . . 125414 forward | catalytic, putative | PTHR10992 | PANTHER | ALPHA/BETA HYDROLASE FOLD-CONTAINING PROTEIN |
| | | | | PTHR10992: SF198 | PANTHER | ESTERASE/LIPASE/THIO-ESTERASE FAMILY PROTEIN |
| | | | | PF00561 | PFAM | alpha/beta hydrolase fold |
| | | | | KOG1454 | KOG | Predicted hydrolase/acyltransferase (alpha/beta hydrolase superfamily) |
| 30055.t000016 | 30055.m001546 (primary) (SEQ ID NO: 75 and 87) | 30055: 126230 . . . 127822 forward | catalytic, putative | PTHR10992 | PANTHER | ALPHA/BETA HYDROLASE FOLD-CONTAINING PROTEIN |
| | | | | PTHR10992: SF198 | PANTHER | ESTERASE/LIPASE/THIO-ESTERASE FAMILY PROTEIN |
| | | | | PF00561 | PFAM | alpha/beta hydrolase fold |
| | | | | KOG1454 | KOG | Predicted hydrolase/acyltransferase (alpha/beta hydrolase superfamily) |
| 30055.t000017 | 30055.m001547 (primary) (SEQ ID NO: 76 and 88) | 30055: 129649 . . . 131381 forward | catalytic, putative | PTHR10992 | PANTHER | ALPHA/BETA HYDROLASE FOLD-CONTAINING PROTEIN |
| | | | | PTHR10992: SF198 | PANTHER | ESTERASE/LIPASE/THIO-ESTERASE FAMILY PROTEIN |
| | | | | PF00561 | PFAM | alpha/beta hydrolase fold |
| | | | | KOG1454 | KOG | Predicted hydrolase/acyltransferase (alpha/beta hydrolase superfamily) |
| 30055.t000018 | 30055.m001548 (primary) (SEQ ID NO: 77 and 89) | 30055: 144327 . . . 146137 forward | conserved hypothetical protein | PTHR22952 | PANTHER | CAMP-RESPONSE ELEMENT BINDING PROTEIN-RELATED |
| | | | | PTHR22952: SF35 | PANTHER | SUBFAMILY NOT NAMED |
| | | | | PF00170 | PFAM | bZIP transcription factor |
| | | | | GO:0003700 | GO | sequence-specific DNA binding transcription factor activity |
| | | | | GO:0043565 | GO | sequence-specific DNA binding |
| | | | | GO:0006355 | GO | regulation of transcription, DNA-dependent |
| | | | | K14432 | KEGGORTH | ABA responsive element binding factor |
| 30055.t000019 | 30055.m001549 (primary) (SEQ ID NO: 78 and 90) | 30055: 149846 . . . 157746 forward | conserved hypothetical protein | | | |

TABLE 6

Lineage of the determinate castor hybrid plants of some embodiments of the invention

| Steps Number | Breeder Reference Number | Season | Genealogy | Generation | Plants per Population | Determinate/Non-determinate |
|---|---|---|---|---|---|---|
| 1 | G-01 | Spring 10 | | F5 | 25 | non determinate |
| 2 | G-02 | Spring 10 | | F2 | 250 | non determinate |

TABLE 6-continued

Lineage of the determinate castor hybrid plants of some embodiments of the invention

| Steps Number | Breeder Reference Number | Season | Genealogy | Generation | Plants per Population | Determinate/Non-determinate |
|---|---|---|---|---|---|---|
| 3 | G-03 | Fall 10 | G2 × G1 F1 | F1 | 6 | non determinate |
| 4 | G-04 | Spring 11 | G2 × G1 F2 | F2 | 250 | non determinate |
| 5 | G-05 | Fall 11 | G2 × G1 F3 | F3 | 30 | 1 determinate plant/30 plants |
| 6 | G-06 | Spring 12 | G2 × G1 F4 | F4 | 11 | determinate |
| 7 | G-07 | Spring 12 | | F10 | 25 | non determinate |
| 8 | G-08 | Spring 12 | | F6 | 25 | non determinate |
| 9 | G-09 | Spring 12 | | F10 | 25 | non determinate |
| 10 | G-10 | Spring 12 | | F6 | 25 | non determinate |
| 11 | G-11 | Spring 12 | | F6 | 25 | non determinate |
| 12 | G-12 | Spring 12 | | F7 | 25 | non determinate |
| 13 | G-13 | Spring 12 | | F4 | 25 | non determinate |
| 14 | G-14 | Spring 12 | | F2 | 250 | non determinate |
| 15 | G-15 | Spring 12 | | F2 | 250 | non determinate |
| 16 | G-16 | Fall 12 | G-02 × G-01 F5 | F5 | 25 | determinate |
| 17 | G-17 | Fall 12 | G-02 × G-01 F5 | F5 | 25 | determinate |
| 18 | G-18 | Fall 12 | G-02 × G-01 F5 | F5 | 25 | determinate |
| 19 | G-19 | Fall 12 | G-02 × G-01 F5 | F5 | 25 | determinate |
| 20 | G-20 | Fall 12 | G-02 × G-01 F5 | F5 | 25 | determinate |
| 21 | G-21 | Fall 12 | G-02 × G-01 F5 | F5 | 25 | determinate |
| 22 | G-22 | Fall 12 | G-02 × G-01 F5 | F5 | 25 | determinate |
| 23 | G-23 | Fall 12 | G-02 × G-01 F5 | F5 | 25 | determinate |
| 24 | G-24 | Fall 12 | G-02 × G-01 F5 | F5 | 25 | determinate |
| 25 | G-25 | Fall 12 | G-07 × G-06 F1 | F1 | 6 | non determinate |
| 26 | G-26 | Fall 12 | G-08 × G-06 F1 | F1 | 6 | non determinate |
| 27 | G-27 | Fall 12 | G-09 × G-06 F1 | F1 | 6 | non determinate |
| 28 | G-28 | Fall 12 | G-10 × G-06 F1 | F1 | 6 | non determinate |
| 29 | G-29 | Fall 12 | G-11 × G-06 F1 | F1 | 6 | non determinate |
| 30 | G-30 | Fall 12 | G-12 × G-06 F1 | F1 | 6 | non determinate |
| 31 | G-31 | Fall 12 | G-13 × G-06 F1 | F1 | 6 | non determinate |
| 32 | G-32 | Fall 12 | G-14 × G-06 F1 | F1 | 6 | non determinate |
| 33 | G-33 | Fall 12 | G-15 × G-06 F1 | F1 | 6 | non determinate |
| 34 | G-34 | Spring 13 | G-07 × G-06 F2 | F2 | 250 | 66 determinate plants/250 plants |
| 35 | G-35 | Spring 13 | G-08 × G-06 F2 | F2 | 250 | 49 determinate plants/250 plants |
| 36 | G-36 | Spring 13 | G-09 × G-06 F2 | F2 | 250 | 62 determinate plants/250 plants |
| 37 | G-37 | Spring 13 | G-10 × G-06 F2 | F2 | 250 | 60 determinate plants/250 plants |
| 38 | G-38 | Spring 13 | G-11 × G-06 F2 | F2 | 250 | 46 determinate plants/250 plants |
| 39 | G-39 | Spring 13 | G-12 × G-06 F2 | F2 | 250 | 57 determinate plants/250 plants |
| 40 | G-40 | Spring 13 | G-13 × G-06 F2 | F2 | 250 | 58 determinate plants/250 plants |
| 41 | G-41 | Spring 13 | G-14 × G-06 F2 | F2 | 250 | 56 determinate plants/250 plants |
| 42 | G-42 | Spring 13 | G-15 × G-06 F2 | F2 | 250 | 60 determinate plants/250 plants |
| 43 | G-43 | Fall 14 | G-07 × G-06 F6 | F6 | 20 | determinate |
| 44 | G-44 | Fall 14 | G-07 × G-06 F6 | F6 | 20 | determinate |
| 45 | G-45 | Fall 14 | G-08 × G-06 F6 | F6 | 20 | determinate |
| 46 | G-46 | Fall 14 | G-09 × G-06 F6 | F6 | 20 | determinate |
| 47 | G-47 | Fall 14 | G-09 × G-06 F6 | F6 | 20 | determinate |
| 48 | G-48 | Fall 14 | G-10 × G-06 F6 | F6 | 20 | determinate |
| 49 | G-49 | Fall 14 | G-10 × G-06 F6 | F6 | 20 | determinate |
| 50 | G-50 | Fall 14 | G-10 × G-06 F6 | F6 | 20 | determinate |
| 51 | G-51 | Fall 14 | G-11 × G-06 F6 | F6 | 20 | determinate |
| 52 | G-52 | Fall 14 | G-11 × G-06 F6 | F6 | 20 | determinate |
| 53 | G-53 | Fall 14 | G-12 × G-06 F6 | F6 | 20 | determinate |
| 54 | G-54 | Fall 14 | G-13 × G-06 F6 | F6 | 20 | determinate |
| 55 | G-55 | Fall 14 | G-14 × G-06 F6 | F6 | 20 | determinate |
| 56 | G-56 | Fall 14 | G-14 × G-06 F6 | F6 | 20 | determinate |
| 57 | G-57 | Fall 14 | G-15 × G-06 F6 | F6 | 20 | determinate |
| 58 | G-58 | Fall 14 | G-15 × G-06 F6 | F6 | 20 | determinate |
| 59 | G-59 | Fall 13 | Kaiima germplasm bank | F10 | 10 | non-determinate |
| 60 | G-60 | Fall 13 | G-02 × G-01 | F7 | 10 | determinate |
| 61 | G-61 | Spring 14 | G-59 × G-60 F1 | F1 | 10 | non-determinate |
| 62 | G-62 | Fall 14 | G-59 × G-60 F2 | F2 | 180 | segregated |
| 63 | G-63 | Fall 15 | G-60 × G-52 F1 | F1 | 10 | determinate |
| 64 | G-64 | Fall 15 | G-60 × G-48 F1 | F1 | 10 | determinate |
| 65 | G-65 | Fall 15 | G-60 × G-57 F1 | F1 | 10 | determinate |

TABLE 6-continued

Lineage of the determinate castor hybrid plants of some embodiments of the invention

| Steps Number | Breeder Reference Number | Season | Genealogy | Generation | Plants per Population | Determinate/ Non-determinate |
|---|---|---|---|---|---|---|
| 66 | G-66 | Fall 15 | G-60 × G-51 F1 | F1 | 10 | determinate |
| 67 | G-67 | Fall 15 | G-56 × G-60 F1 | F1 | 10 | determinate |

Example 5

Expression of Castor Genes Located within the Associated Determinate Deleted Region and During Plant Development Stage Materials and Methods Plant Material Castor (*Ricinus communis* L.) plants from the determinate inbred line, G-60 (see above), and the non-determinate inbred line, g-10, were cultivated in pots in the greenhouse. Tissue samples were collected from buds, leaves and roots at different plant developmental stages. G-60 plant tissue samples were collected at 2 leaves, 4 leaves, 6 leaves and upon blossom onset (pre-blossom). Plant tissue samples from G-10 were collected at 2 leaves, 4 leaves, 6 leaves, 8 leaves and upon blossom onset (pre-blossom) due to later blossom stage. All tissue samples were flash-frozen in liquid nitrogen and stored at −80° C. for further analysis.

Isolation of RNA and cDNA Synthesis

Frozen tissue samples were ground to thin powder in liquid nitrogen. Total RNA was isolated from 100 mg tissue samples using the HiYield™ Total RNA Isolation Kit according to the instruction of the manufacturer (Real Biotech Corporation). A portion of total RNA (1 μg RNA) was reverse transcribed using the Verso cDNA synthesis Kit (Thermo Scientific).

Primer Design and Quantitative Real-Time Polymerase Chain Reaction

Primers were designed using Primer3 software (www(dot)/primer3plus(dot)com/cgi-bin/dev/primer3plus(dot)cgi) to produce amplicons between 70 and 150 bp. The primer sequences used for the qRT-PCR including two house-keeping genes, ubiquitin and GAPDH, which were used as internal reference genes are depicted in Table 7. The qRT-PCR was performed in 96-well plates in a StepOne Plus Real-Time PCR system (Applied Biosystems). The qRT-PCR reaction (total volume 12 μl) contained 4 μl cDNA (13 ng), 1.5 μl primers (2.5 μM of each primer), 0.5 μl water and 6 μl Fast SYBR® Green Master Mix (Applied Biosystems). The qRT-PCR reaction was performed as follows: initial melting step at 95° C. for 20 seconds followed by 40 cycles of 3 seconds at 95° C. for denaturation and 30 seconds at 60° C. for annealing, elongation and fluorescent signal acquisition. Melting curve profiles were obtained by incubation at 95° C. for 3 seconds followed by a 0.3° C. step-wise warming from 60° C. to 95° C. The relative cDNA level of each sample was calculated using the $2^{-\Delta\Delta C_T}$ method.

TABLE 7

Primers used for qRT-PCR analysis.

| gene | Forward primer/ SEQ ID NO: | Reverse primer/ SEQ ID NO: |
|---|---|---|
| 30055.m001538 | GACGCAGAACCTGAT GATGTTG/91 | ATCTCCTTTGGGCGACTG TAC/92 |
| 30055.m001539 | TCTCTGCGTGAACAA TTGCG/93 | TGAAGGCGAGTTTTGCGT TG/94 |
| 30055.m001540 | TGGTTTCCAAGCTGT GATGC/95 | TGTGCTGATTTCCCAAAG CC/96 |
| 30055.m001541 | TGGTGTGACTTGCCT TGTTG/97 | CCTTTCCATTGCTTCAGA GAGC/98 |
| 30055.m001542 | AAAGCTTCCATGGCT GTACC/99 | CCCCCACATATGCATCTG C/100 |
| 30055.m001543 | TTCTAACGGTGCCCT TTTGG/101 | TCCGGACTACCTTTCCAA GAAC/102 |
| 30055.m001544 (TFL1) | ACTCTGGTAGTGATG ACAGACC/103 | TGGCCTTGGCATTTCATA GC/104 |
| 30055.m001545 | ACCCTGGTTGTTCTA CTGGTG/105 | TGGCGAACCTTTTCCTGA AC/106 |
| 30055.m001546 | TGCTGACCAAATGCA ACTGG/107 | ACACCAGCTAGCCTGTGT G/108 |
| 30055.m001547 | AGCGCATGACATTGA AGAGC/109 | TGTACCTGCTAGCCTGTG TG/110 |
| 30055.m001548 | AACGGAATTGGGCAT GCAAC/111 | CCGTATACGCCTGCTTCC TAG/112 |
| 30055.m001549 | TGTTGATTGTGTCGG CTCAG/113 | AGTGCTGGAAATGGCAAC TG/114 |
| 30169.m006323 ubiquitin | ATCGATCGAATCAAG GAACG/115 | CACCCTCAATGTTGTAGT CACG/116 |
| 30190.m010986 GAPDH | GCTGCTATCAAGGCT GAATCTG/117 | AGCCTTGGCGTCAAAAAT GC/118 |

Results

The determinate castor plant (G-60) comprises the deletion at coordinates 60520-152129 on the 30055 scaffold sequence (SEQ ID NO: 1), which confers that determinate phenotype.

In order to evaluate the contribution of the annotated genes located in this deletion region to the determinate castor phenotype, the present inventors studied the expression of the genes listed in Table 5 in different plant developmental stage. Plant tissue samples from the determinate castor inbred line (G-60) and the non-determinate inbred line (G-10) were collected from different plant parts at different plant developmental stages as described under Material and Methods, hereinabove. For gene expression evaluation, shoot apexes from G-60 and G-10 inbred lines were dissected and for example 4 genes (see Table 5) mRNA expression levels were determined by qRT-PCR. Shoot apexes which were collected from plants at 2, 4, 6 and 8 leaves are essentially leaf buds, whereas the shoot apex at the pre-blossom stage is a flower bud.

As expected, G-60 inbred line samples did not contain mRNA detectable levels of the genes listed in Table 5 hereinabove. In contrast, all the 12 genes (see Table 5) were expressed at different mRNA levels in the various plant developmental stages in G-10 inbred line (see FIG. 5).

Results demonstrated changes in mRNA expression at different plant developmental stages. Major differences in mRNA expression level were found comparing 8 leaves to pre-blossom stages. 30055.m001542 (SEQ ID NO: 83), 30055.m001544 (TFL1) (SEQ ID NO: 3 or 4), 30055.m001545 (SEQ ID NO: 86) and 30055.m001547 (SEQ ID NO: 88) showed downregulation in their reproductive tissue differentiation (see FIG. 5).

Downregulation in the expression of those genes at pre-blossom suggests a potential role in flowering inhibition. Lack of expression of these genes in non-determinate castor inbred lines could promote flower differentiation and early blossom as in the determinate inbred line described in some embodiments of the invention. For example, TFL1 (SEQ ID NO: 3 or 4) is known in the art as a flowering inhibitor. In the current study, SEQ ID NO: 3 or 4, TFL1, mRNA expression level was dramatically downregulated pre-blossom, consistent with the art (see FIGS. 6A-B). FIG. 6B clearly demonstrates that while TFL1 was expressed in 2, 4, 6 and 8-leaf samples collected from the non-determinate (G-10) leaf buds, no TFL1 mRNA expression detected at the pre-blossom stage similarly to the determinate castor inbred line (G-60) observation (FIG. 6B). These results further support the hypothesis that genes that were dramatically downregulated or upregulated within the deletion described hereinabove are associated with the determinate castor phenotype.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (130 sequences)

SEQ ID NO: 1 - DNA, 533227 bp, Ricinus communis
  misc_feature (5238)..(5681): n is a, c, g, or t
  misc_feature (20877)..(21446): n is a, c, g, or t
  misc_feature (22444)..(22446): n is a, c, g, or t
  misc_feature (28811)..(28887): n is a, c, g, or t
  misc_feature (35406)..(35676): n is a, c, g, or t
  misc_feature (59882)..(60128): n is a, c, g, or t
  misc_feature (64448)..(64606): n is a, c, g, or t
  misc_feature (66950)..(67112): n is a, c, g, or t
  misc_feature (92435)..(92464): n is a, c, g, or t
  misc_feature (94694)..(94736): n is a, c, g, or t
  misc_feature (98653)..(99025): n is a, c, g, or t
  misc_feature (105513)..(105515): n is a, c, g, or t
  misc_feature (107412)..(107654): n is a, c, g, or t
  misc_feature (112159)..(112268): n is a, c, g, or t
  misc_feature (114476)..(115167): n is a, c, g, or t
  misc_feature (141935)..(141937): n is a, c, g, or t
  misc_feature (143035)..(143037): n is a, c, g, or t
  misc_feature (165021)..(165258): n is a, c, g, or t
  misc_feature (180452)..(180739): n is a, c, g, or t
  misc_feature (182413)..(182532): n is a, c, g, or t
  misc_feature (190003)..(190112): n is a, c, g, or t
  misc_feature (192020)..(193104): n is a, c, g, or t
  misc_feature (197966)..(199382): n is a, c, g, or t
  misc_feature (201887)..(202033): n is a, c, g, or t
  misc_feature (225040)..(225042): n is a, c, g, or t
  misc_feature (255900)..(255902): n is a, c, g, or t
  misc_feature (322532)..(322569): n is a, c, g, or t
  misc_feature (324861)..(325105): n is a, c, g, or t
  misc_feature (353048)..(353265): n is a, c, g, or t
  misc_feature (411192)..(411279): n is a, c, g, or t
  misc_feature (424016)..(424018): n is a, c, g, or t
  misc_feature (440598)..(440670): n is a, c, g, or t
  misc_feature (500612)..(501085): n is a, c, g, or t
  misc_feature (509819)..(509891): n is a, c, g, or t
  misc_feature (528732)..(528790): n is a, c, g, or t
  misc_feature (531958)..(531960): n is a, c, g, or t
atagttatattaatattaattggcaattaatatagttttagagatgaaagaaaaaataaaaatagttatttcataaaagtttaaactaaaaaacttaccgcaatccaaggaaataccttaaaaatcataaaagatctcaagtgaggatagagaaagtcttgctttcatatatatagatatagatttcttgcattctcctttatcacttctctttaattttatttgaagatgaagataaaaataaattaaaaatgaagatggagatagagactataaaatttatattagaatggttatgataaatgatgacttttcgattatcaaaaggaagattattagacataaacattagtccaaggaagattatgagatacaaaatttgcataatataaaattaaggattgttaataacatatataattaaaggaggagataagaatatttatattaatattaatttgttttaaaagcagtacttgagatgaggagttgttcttttcttgtaccaaaaatcttgatacttatagtactaataattataattgattgtttgtataatgaaagattttataactgactcctaaaaaagagtttaggtctatattaatattttatgtcaagtcacatatatgtgccaaattagacatctaaaatattcggacgtgtaatacgatactgtcttaaagacaataataacattattaaattattaaataaataatgtttatattaaaacatatggtaaaaatattaacatatatatatatatatatatatatatatatatatatatatatatattctttatttcaaagtgcaagaaacaactatggctgccttcccccacaacatgaaatcttacgaaaaataataaacatttttggagacttaaaggacgattctgtgtatacacaagtcaaaactgaaagcaacatatgcacgtattaatcgagacaaacccacattaaatatttcaagcataagtctatactccaatgcaagtaaaaaaacatgccttaatcattatttatgtcatcttttaatattttattacagaatttgggtccattgaactagcgacctgcactattattaaatgaatgagatactttaagaaaatttggtccaataagagcaaagtgaaatccatttcttttaaactttgggttaatagctacatacataatatgagcttaattaggtaaacaagccagcctaaacaaacctaattaaaacgtataatcttatatacatatttttaaatcgcgtcatatatcacgatttttttttatatttctttataaatacctacttcatttcttaaaataataaatttatttcagaagggaaagcgatgggcataggtggccgatttaggtgtgcatccaagtgtacgtagcgatcacgatacgatataatttttcaatctaaatagaaatatactaattagtcactaaaattggcatatataatagaattatcatctcggtaatcatcaggatactctttttaatttttatggtatatttaaattcattagaaaaatattactacatcgagaaatgaattcggttaaatgtttttagttatgttttttttactttaattttattatttaataattcatattctctaacgctttctaaattattataagtttttttaaactcttcataatcatcatcattcaatcatataacctactagatattcagccatcattgttgaaagagacgtgtgattatacatattttcaaatattactcacttttccttacatgtgtcaattctttccatagcagtctatccctcaagcattggactaaagatattaatttaccaaaatacataaatttatcgtattttgacaacgatagttagcaatttttaatggtgtttttttataatttttaaacagtaatacagaggacacactaaacagctgttaaataaagatttataaataacaaaatcaaaagttaaaaagttctaatcgaactaaaaatcaaatctaagatatcaattgccaaaatatgataaattcacagtgccatttatatatttagtttatttagtcattgaagaaaaagtaaaacttaaaaatcattaaattattataattattgttattattatcttcatgaacattggcttaaccataaggataagcaatggaggattgtctgacaaaattatgtaggcaaaagcggacaacgaagaaaaaggtgttgcagctcaattttatcaaatacctggcaaaagctacaattacttaagatccaaatggatttcatatgatcgacagtggatctctatgtctcacaagtcaagtcaccgtgtttcttccacagattaagggatgaacaaagaagacaaattttcatccttctttaacagaaatagatacgtgatgcgacataaggcaaaataaatatattaaatcttttcttaaaagataaaaaataaaaccctagaaaaatgtttatcattgaattttgaaatcaaatccaatttatgaaataacagatacaaaaaatcaatccaaataatttgggacacctgatcataattggtgtagatgcttctatatttaaattatatcttaagtttattataattattattatgccactataaaatattgtagacttttgattaattatagggtagcaagataatcattatcatattaatggatgctcgaagtttatttcttttgaaagtaaacaacatatcatcgaattaactagcaaagatacatcagcagcaatcagagttcctaaccgaactggaatctcatgccacacatgcgctactgcaaaagaaacctgagaatttctgcctgatgaacacaacaccttacaatcagaaataacagatacaaaaaatcagaaatatcagcagcaccagaaagcacaatgtcaacaactttccttgtagtcaagctcaaacatgatattctgaaagtgctttctgcctgtgatattgtctgcatgaggctccgtctgattcgaggaaactaacttgtttatggtaataaaattaataataataattattatagaattatttgaaattatttgaaattattaaaaaaaaacgaatttattgcaaatttcttctgagttttaataccactgatgattatgaacatgcattgcctgggaggtttaacaattataatatattcataaatagtaaataatgctaattttttttttagagtcgatgaagtctcaaatttaaaattttgttcaagttaaaacatataaatcaattgctccgttgatactaaatttatggatcttaagtattaatttagggtatttaaaactattctgatttatttttgctcatgtgactattaaaactaaaataatgttaattgatttgtcacgttaattgtaacacccccatcacatgctaaccaataaacattagccaggaagcatacaagcgtcgtagaatatatactacaggtagataggtcaatatgtaggttgttaagaatccagacacaaggttattaacatataaacatatgattatacttaaacatcatttaacaagtattacaaacatcttcttatgccttctaaggcatacttccatatatatagcacataactgcacacaaaaatgcatcaggaggagacttcacaaaactggcccaacttgacagaactgctaaaagctagacttcacatacaaccaacggatgcactactatttacaaacctgaaaagaaaaattttggagaggggtgagcctccagctcagtaaataaataatcaacataatctatatcacatacacttaatacaatttccacccaatcacataactttctatgatattcatagtttaggtataaagtcataccattctactcaattcattacaaccatcatagaagaaatacaattcaacaattatggttagttctcacggcttgtggatcccctttaatgtgctgctccgcctcatcctcacatatcacacacgtaagctgctccacctcatctcacattatacacttttatagcctctctaggctttagcctcccaaggctttatatatatatcttttttttttcataggagaatccaccattcacatgcacatatgcacttaacatcacaattcaatcatttcacttatatcatatttcagcaataataattgttccactcaacaccaatcatttccatctcagtcattcaaacataaacaatattaagcaaacgcaaccatttgcggaacatttgattaaatatatgaacatagcaaatattaactatttacttactcaaaatatacttattcctttagcatataagaacctcctttctccacaacttcctttccaggcctttgagtacctgtcaacacattcatcaattcacatttcatgcatattccaaatattcatgtaaatgctagttctaatgcattacaagatcatcccctctctaattcatattaactcttcctctaagactctcaattattgttttaatatcctataaacattttccatctagttaaataccaatttaactcaaattaacatcaataaattgcataaaactaatctccaacatttctgttttctagacagaatttagtaccaaggtatatttattgctgggcaaaattggcttaatacaaaaatctcatattaaatagacatatccatttatgagtctagtttcatcttcaagaagaattactcaattccgacttctatagatttaattattttcaaattactgagcaagggtcatacagctagttgtacccgagcagcaatctgttttgctcaatttaagcaaccaaaacggcaaaaatagcaaaatcacaaaactacaaagttatagaggactctttaaaatttccatagataccaattaagcttaatttggacttatataacccatgttatgcctaaaatacagaacatcaaggttgctggaattttgacagttttctatcttaacatacttaaacttaaatcaagcttaatctttatgcaatcattcaatactctactaattcatgataatcagacatttaattaatcaatgagagcatcaaatgaagtttttccaatttgtaatcaagaatcctaatgacaaattaataacactcaagtaacaacttaccaatttcagcttttgggttgctaatatgcttaaatcctttagctttagcttggctccttcaatagttggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttttattgtatcttttagtccatctatttacccaaccttcaactattggttcaattaagtcttaaggcttaatacacataacccaagtacttaatcaacttatctaaattaataatctaatatcatgcttcttattctctacttataattaatatatatctgttctcataaaataaaaatatcattgatataccatcatatgcccaatgattaaatgtaaatgcacataacatggatgatgagaaaatgcaggcgttacattaataatgtcaattcactagtaatttatcctactaagaacattaggcacacctctaaatgagtatattttgaaaaaaatataaaggtacgtcagttatacttaatataataagttgttagtgagttaactttattgatatagcaaatcaattaaaaatatctatgtcaatataaatagatcgaaaaagtagtaaataccctaaattgaaataaaaagatattggtacaattagatattagatccaaaagtttggtactaacgtagcaattcacccttaaatatgcagttactgccactttgaagcataaattttagggtaaaatggtttgttgttggcatcatatttttggacttcgtatcaatacttttattcttgtttcaatttagagtacctataatttgataacctaatattggcttgctctgggagtcattcgttggtcaccgacaaaagtgttatttgcaataattgtttgaatttgaaactgtcaagttttctgagtgctatccttttcacatttcagacgagtgatgcaccagattactagtctcccattaattagcacaactcccaccccacctacctttcgaccctgaaatttaaaaacttttgccctttgtatagcaaatctccatacttggtactttggatctgttttaattatttgtttttgttagagatatttttaaggagtggacctataattctctatatttttaataattttttttgtttttaaatttataacggcctgtcggttgtggggtgcacaacaataaatattcatagtgataagttttctattaacatttctaattttcataatatgaaattgtcagttaagatatattttgattaacttttaattatatattctttaattaaaaactaaacgaatattataaagtatgatatacctccaattctttaaacttcaagcaacatataattccaagtttataaatagaactgaaaattcttaaatttaaaaggatagtaaagagtgtgagattgtactgatcttaacttattttgactggttcaagttacatattagtattaatttcaaagtatttatagattcataagttacttcctaaagaattatctaccctacaagaatgaaatctgaaatgatagagtgtcaatctaataaatcctgctaacttgccctttttagggcttaggaaaaaacattgaattctcacgacaacaagaaacctagctcaaattcacactcttaattatttatatatgattggtactgtgaattccaaaattagatcttttctactatagcactttgtttatttcaccactcattcttaatttcaaagtgcaagaaacaactttggatgccttcccccacaacatgaaatcccacgaaaaataataaaagttttggagacttaaaagggaccattctatgtatacacaagtcaaaactgaaagcagcatatgtatgtattaatcgagacaaacccacattaaatatttcaagcataagtctaatactccaatgcaagtaaaaatttcccttaatcattatcatatgtcactgtgcatcttttaatgttttattacaggatttgggtcgattgaactagccaccaacactacctgagtaatccatatagtccactttaatttgtataaactcttatttagctgatgtgccttataatatttttacaaaattattcttaatatttttagattgctcttttaattgataatgtaatttcataaaagtattatatatcacaatcagatagataagagttaaagattatcatattatttcattgctatttgtccagctgtttatcagtttcagactctattaatagtatgagttatgatattaaatctcttattattttttctattgttatttttttattctctgactgagttttatactcactcttttattttaatatttttcatatttatttattaatcagtagtaggttcttttgagcattgtcctcatttccacttcaatgaaatcagctttagtggaggttgatccaacatgcttaattattatttttgttaatctcgaattatgtattattcttttgttagcctatgagttaataatattattttttcactcttattttttaattcgggctcagatattcctcagcaattattaagtgttatgaacctaatattaatggttagatgtctaattcactagtttgtgttcatgatattcattttagtgatatattaacaagtaaattacaatataaatttagagtgtcagtctctgtagcacctatctacccgcgtagggtcgagtgttacaatctgaccacccgctaggactgaatatccatatgaaaaataaaaaagttaaaaaacatcatacatctaaatagaaaactcgataattaagaaacaaagtgaataggtaaagcatagagcctaccaataccaaaatgactaaaattagtcatttaaatagttgaatcttaaatcttatatgttcaaatttttacataaaatgagagaaagaatgcacgttttgcaaccggtgacaaaaatggttttattctcaagaaaatgaaaaccacttccaaactaatatagattgaagggaaattgccaaccactgagattatggcagaatggttgttattgaatggttgcttttcatcatttaatgaagatggaaaacatagttttcatttaaaaagcaatataggctcctttttcttttctaacttctgtttatatgaaaaatcagaacaagaaattaataaatatttgatatacatctatgtcttttgctttttctctctttctaaagcatttttcaattaaggtaaatgaataatatgttaaatgaagcaaagaaaaactaatttaaaaaatgtaaataattgaaagttatatatagattaacaacgatgtaaattaatagaataaaataaaaaaaaatcaacaaattaactaaataatactgattgatataataatattaattcaaagaatataaatattacatattagcatacctatatatagaaaatttattacacatatcaaagcttttatctgatgggtaagaacttaccctatgtactaaaatttccatgtatatatatatataatgttttagttgtgaatatttattatggattgaatcctttcattttcacatggacatgatcaacagtactttttgaaattaattcattaaaatataatttaaaattatataaatagaaaagtgattcatatataactgattttagagaaagagaaaatacatttttatttttaaaatttgttttatgatataaatatgtttttcgtgtaattttagggatatatatttaacaatatatctctgaatatttatgttacatgatttttataaaataaattaaaaaattaagtgactctaagtgtatatttaagtcacttttagatccaatcatctctacttggattggtgcccatagcttgtaccaatggtactaaaaatattgttccgctcttatccaatgatttaatatattttctgttataactgagaaatagacaataatattaagttagcagtgaataaaataagaaaatcctaacattttaaaagtattataaaagtgtcattattatttaatatagttatattagttataaagtatatcacattatatgttttatttataaaaagaaagtaaaggaaaggtaataaagagaatgtctcaaattatatatagttgattgggggcaaatgcattaattcagtaactcaaacaagcacatgtgtgttccgtacagggttgattgagatttgatattgatccatatagaatatgaagagacaatgtgtaataaatgagagaattaacacgtgagaaaacaaccaagagtttgtttggttagacttatggatgctgttgatagttagagtctcgatagctaatagttggtagctaataatttaattttttttttgataaaatttataaaaatatacaaaaatatatcttatagttagacacttttacattcagcgtattgttaatctgtgtcaacaataaatatttgtttagatgaattatataagaagtttatatatttagattcgatttttattgtattatcttatgcttgtgatttaaggaaggttttcgaagtattttgtagtttgtagtgtgaatttgaaagtgaagaagaagagagatttaaagttaatacgtgtgaagggtgtaattctatggagggcgcaacgtatcgcacatacaacagactgattataacttattccgtttttaatgtttgttagcatgttgaataaccatttagaatataatttatttttaaatatattttatttaataatattattttaaatatataaattaataaaaaaattataataactaaaaaggccataataaatatatttaacttaattatatttattaattaaaatattcataaaacttattttaaaaaaagatattagaatttatattccactaattaaaagaattatgatttcaaaaattataattatgaatatcataattatttaactattgactataattttaaaataataatgataaatggagaggtgataaagtaagtatgagagaaagaaaactacagacaacttttatgtagaagagaataataagattgaatttgtattctaaattatatttcacaatgagagtgttagtgtctatttatatacacatctttagctaaaataggaaaactaaattagtgcctaattaggcaataggagaatagtgtttaattaccccctaattaggcaataggagaatatactagaatatacatatcatcatcccccttcaaactcgcgaaaccgaggagcaaaatgcaccttagtgaatatgttagcagcatgattttgagaggatacaggaacaaactcaattgtgtgattttgaacatgatgacgtacaaagtggtaatcaatctcgatgtgctttgtccgttcgtaaatacatcattatgggcaatctgcataacacttcgattatcacagtgcaaaatagtagcagatggagaagaaattcccatactttgaagtaaccaacggagctatagaagctcggagtcgtatctgtaagggctcgatactctgcttcggtactagagcgagagacaacagtttgcttcttacaacgccaagaaattagtgaattgccaaggaagaaacaataactagtagtagatcgtcgatcagtgggatcacctgcccaatcaacatctgaacacccttgcaattgaagagagaatgagctagaataatgaagtctatgaaatagagttcctttaatgtagcggagaatacggagaactgatgcataatgtgtgatacgagaagctgccatgaactgactaacaatatggacagcacaagaaatatcagatcgagtggcagtaagataaataagacggctaacaagttggcagtacaaagtacaatcgggaagagtagagccatctgaagtagccattgtaataaatcaaagaaaatttttcagaaataatgagatctaaatcaaaccggagataaaaagtctaattttgacaaaacagacctcaaaaaaggattcagaagggtcaaaaaccttaggaaccgttccgagttgaaaaaaaaaaactgaccagaaaatagatgaaccggactgaccaaagtgaactggttttcttgaaccggacggctacaaaccaagaatcaaaaactacaggcagctgaataaacgacatagtgaatattgagcattcaaaatacttgtcgttttgattgtcttcaacctccaagctttgtaacgttttgaattgtgacaaaaacttctggcagaccgtaacagagcgtttgatgtccgtttggactgatttttacggcattgaattcgtcatagagaaaagaatcttccagtggtgatggaagttaaattcggtgaaagaatattgagaaacggcgtaagaaacagaaactatactattgcacaaaatcaaaagaaaataatatgcagaaaatataaccacccttaaaatggagactctgataccatgtagaagagaataataagattaaatttgtattctaaattgtattttacaatgagaatgctagtgtctatttatatacatattttttgctaaaataggaaaactaaattagtgcctaactttgccatatgtttgatttattttaattttaattttttaatttttctgtcatgtcttttctttaatatttttttaattatattaatgtatttcatactcaatattcatttcatttagaatgaattttatatattctcttatcatattaaatatgaaaatttatttattaataaattctatttatttactaagaaaatgaatcttttaataaatttctaccaacattttagcttactaaaaagtgtaaaatgattgcatttttataagatagtaatatttttcttaactacaaaaacatatgatgtttctgataatttggaacttccttataaaagtattaatttatgaaaacaaatcatgttttagataaattataattttcatgttattttcataataaaaagatattttactaccacattcttaataggaaaatgttagtattgtgatgaaagattatttttcatgcacaaaaatttattgaattgaagaaatgtgtgtaaatcatgcaaaattatattccttttcattactttacattttaccggtttataagaaaataacaatatttttttataaattttgattttaattttaaatagtatttaaattaatttttcaacttaattcccggtttactatatataaaaggtctaaacttttaatagtattacttagattcgttaaaagtcaagggttaataaaataaactatcctatatcttatttagaagaaagtacgaaccgagcatttatacatatttttcaaactagttatgactttacgaatattctgcttatctcttttgtttttttattttttcctattttatactaaaaggaatagactaaaaggttacttgttttattcactaatatcaaattatgttgagaattatggatgagttcaaatgaatttagttattggccagagcctatcacaatctgaaaaattaatattcaaactctactgtaatcagaagttagatagcctactttgccaagaacatgaaaatacgttctcaaattataggtaagctgtcagctagagcttaaagcagattacaacttcgattttcctattaaaaaataacacaaaaaaatatatttaaaaattaatctaattgagctaagcgcatataaataagatattaagagttttttctaatttaattaaaatttcaaatttaaattaagtacggtacgttaaaactctagcacagctttataagtaccaaacacatttaaagtatcctcgtctcacaaattagtagaccataaaggagaaagaaaaaagatatataaaaagaagaactccgaaactatttccaaaactgatacacagaaaggttggaaaattatcttcaaaatcaatggaggttggaagtatactagagtttcttgagaacaagaccattttggctactggtgcaactggatatctagcaaagagtatataatatatgccctttctcttctctcctttttagcgtagtgtaagatatttaggtgcaattactgctaacgacttttctttgatgggtgtgcagtttttgtggagaaggtactgagagttcaaccaaatgtgaagaagctttatcttcttctaagagctgcagatgctgactctgctatggagcgcctaaatcgggaggtattatattcgtctcccctgtaaattctacagtaagggatagttttgaaaattaatatgcactgttttacatgtcaatcttaaggatgtctatctaagctctgtaactttgtaaattctcctgacaaatttttcttggactgacaggtcatagggaaagatttatttaaaggtgtgagggagaaatatggttcaagtctaaactcctttgtatcagagaagatgactcctattcctggtgatatctcccgtgaagacttagggattgaagactttaacttaagggatgagattctgaaagatattgatgtggtgattaactttgctgccacaaccaacttcgatgaaaggtaagtataaggattattacttttttctgcttcactttattaaattctataaagtccttaacatacaaactaattgaagtttctttctctttatctgttttttgggttctgtaaatgaagatatgatgttgcactaggagtcaatacactgggagctttgaatgtcttgaactttgcgaagaaatgtcttaaaatcaggatgcttgtccatgtctctactggtaattacaaagttttcatcatataaacatgattggaacttactttttaagttgttctctaattcatatgttctctgtcagcttatgtatgtggagaagatacaggacttatactagagaagccatttccaatgggtgaagccaagaagggtaaccgtaaaatagatattgaagaagaaaagaaactagtgcaagaaaaactaaatgaacttgaatcagaaaatgcttcagagaaagaaattacagcaatcatgaaggattttggcattgaaaggtattaagtaactagtttagagtgagtcattatatgttaagataattataccaacgattatcaactttacatttactttttcaacttagtcatatataaaattttaatttgattcagccattaaactggtccttttgagtaaaaggaccccaaaatccttaccatttccgactaaaataaatttgtctccttactcctgtgtagggcaaggatgtttggatggccaaacacttatgtatttacaaaggcaatgggggaaatgattttaatgcatatgaaagaagatttgagtctacttattatacggccaaccatgataacaagtacttatagagaaccatttcctggttggattgaaggtgccaggtaattatcctccttttatttcttttcaagattagtgattcagtcttaattaaaatagttttatcttattactaccctaaggcggcagccaaagttatgtatttccatgtttattctatgacgtgtgtgtttccatggcagaactgttgatagtgtaatcgtgggctatggcaaagggaaagtgggatgttttgtctctaggccggagtcagttcttgatgtggtaagctaatctttctcttttattattatttttgactttcggattttcccacagcttttatgcttctagaatataaaacttccaaaacttacaaaattgtctatacagataccagctgacatggtggtgaatggaatcattgtggccatggcgactcgtgctcagaagcaagcttcagaaatcatttatcaaataggatcttccttaagaaaccctttgaagttatcaagtgtgaatgattttagctatcgttatttctctgcaaatccatggattaacaaggaaggagttccagtaaagactagcaaggccattatcttgagctctatgaccaaattctatatatatatggcatttcgttttcaactgccattgaaggtttgcagtcatttaattaacaattaattttatctataaatcaaagttattaacaaatattgtaaagttggaattgaagaatgaaaagacatcttaacaagacctattattaatgaaggaataaattatagctcataaaccacaagttatactaaaatgtcaagcattcttttccttttctcttactagtgtcatactaataattacttgtttattcccaatttaaactctttcctaggcattgcaagtagcaaccattttggtattgaagaactatcaggacatgtgtacagttcttgatcgaaaagtaaaattggtgatgagattggtacaactttataaaccctatgtgttctttgagggcaggtacgtaagagcactatttccttcttttgttggtccatacatttttttttgtttctttaaatacataagcatcaatatgaacatgtaaagattttgcccttaaatttgtttacagctttgatgattccaactcagagaagctaagaatagaagcaagagagagaagtcttgaactaaaagaaatggatgaatttaactttgatcccacagaaattgactgggaaaattacatgatgagtgttcatattcctggtttagttaaatatgtaatgtaagaatcattatattgtttgagttcctaaagggctttccccacacacaaaaattcgagcttctaaagccaataattatttattaattgtataactcattgtattgctttttcctttttttttttttttttctgtttgtttttatcgtattgatttatgaacttattttttcttgcactgatttactgttgcataaactgaaggtttactttcataaaaagaaaatgacaatgtttattaaccaggtcatagctaatgggaattggtttcagtatatacaaaaattcaaatttttgtatattttaataattctgtaaaattcttttaatttttcacaaatttaccaaacaaaagtataagggtttattcaatttctcacaacaaactttagaggcaaagatgcacttcttctctttattccaaattatacaagattaactaaatttctttactattatttcaattgattttcttattaggtcgaggacatatatggtttctaaatatattcatggctttgaatattcttccgacccgctcaaatttactaaaatttcttacataattttatttaatatctttgtgaatttaaattttaaaaaatttgtttatcttataaacagatttagaaatattgtttctttgaagcctatttagcaattatactttgcttaaaaaattataaataaaaatttatatatctaaaaaagcaaaaaaaaaaattcgttacaatcttgggtctatataggcgggctagaccgagctcaaactaaaattaaaataattcaagctcgattaaacccggtccaaaccagcagcttattgaacagatttaatggtctccttttctattatacctataagagctaaaagtcacatatctcccgaagctttttatgatgtttttctcacaatatatcaattttaaccatttaacaggtaaaagtattcctgtgctaattgcttattccacatgcttacaggtcctatcacttttatattagccttatcataactattcttcacgtttagttcaagttacaagaacgtttttatttttaggaatgagaaattcttagcttaattagattattctttttgctggaaaaattgcgaagaatatttgagcatggaatgattaaacatcatgagagtgtctctacttaaagcaaatcacaatccaatccttccatttacatgggacaaaataactgaaaagattaatgaacataatcattatttaactctaaacaaacttttcacaacaattttaaactacattaatcaggaaacatcagaatcatatcacaattaactcacttttaagaaagttcctaatcattttggcagatacatttttaagtaatcctgccatgaataaatgatattactaattccccataccacataaaaatgtagatacaattttcttgagaacaaacaacctcctttctttttttctttttccttttttcttttttgcatgtaacattatttgaaaacatattttaccacaccaggaatatgaacattaacgaagtaatcttcccaatcaatggatttcgggtcgaaatagaacatatcaatctctgtaccattttctctagctgccattcgtagtttttcagtatttatgtcatcgaacctgcatgtcagagttcagtttaaatgaaaaatttattaaaagaatcatagttaattttgatagatacagtgtggtttgagcatggagacatacactccctggaagaacaagtatggcctgtaaagctccaccagtttcattacaaagttgatcttcctattaagatcactatatatgccctgaaaatagtggcaaaatgctgtatttgccagttctagtccctgtcttgcagaagaagaagaaaaaaagtagcaagccacaattaatctaacttattggcctgtaaaatctttgatgctaatatatatatatatatatatatatatatgttttatatttatttattgtatcttaaattcttagaactgacagaatccacatatgtgtcagtttccatgcctcttagaagataattacattattaaactttacatcgaattttcatttattcaataaatttttaatttgattagtaaattcaatcatttaatttctatttttatttcaatatagtcatctctatcaatgaaagattaacaaatcatatttttatttgttaatcattggcaaagatagctaaattaaaataaaatctaaaatagaataattaaaatgaaataaattacaattcaataatcttattaaaattaaatgcaaaattttataatcattagcgtaccatatcggaagtcgtttctagaactcttagatctcataaactcgctatcggggccaatatttaaaaaagaaaaagaaaaacaagggaaaatttgaacaaacctttagcaatagcaagtaacgaactgccatatatctacggaagctagccatgctgtcgagaaccttcaccttgccaaccttgacaggcttcccatccttaccaatccatggtttctttgtgaagtaattaagtccataatcttgaagattagcatatctcaaaggatgtcttactgaggaacctacttgataaattgcgttttcagatggtcgattagcatgagccgtcatagcaacaataattgcattcaccaccatatcagctggtatctgcatgattctcaatatttcactttcaattcaagtgtttaaatattaataatctcatactttaaccaaaaaaattaaatttgaattcttaattgatatattttttattcttttagtttagagcctgtcgaggtttgaattctccgtctattttatttttttattgtatggattcagaattagtctaaataatttagaacggactagacagaattcttgcggatgataaaacactattttaagagttttaaatacagcacctgtatgtataaagttcgaattcgagactttaattaaattaaaagatatatatatttatcatattatttatacgctcttaaatgtatgttttaatattatatagtaaagaaaatatagaaagtcaatgttaaaagtttagctcaccacatcaactattccattaatatcaccaagaaagcatgtcaatcttcctttcccataaccaacggctaaactgtcaattgttctgcaaagaacaaagaaaaattaatcttgtcaaactcgacagcattccttaattaattccttttttttttctttctctttttctttttcattccatttctcaagaatcaaacgcaaaatgctataacatacctgaccccttcaacccaaccaggaaaaggttctttgtaagtacttgttataatggtgggtcgtaaaatgactacggacaaattctccttcaaatgtcctacaatcatctctcccattgcctttgtaaagacatatgtgtttggccatccatagagctttgccctagtcaatcattttgataaaatgttagaaattaatcatcattttgatcaatgtgttagtaatgataatgtcaatcaatgttagcaatgtcaaacaatcataaccattccatttaaatttagatgatattttaagaatggtattattttacttaaaattttaatttattggatcttttttagcaaaaaaaagaagaaaaattaagcattcaatgatgaaattctctttagcctctgatcatatcggctctttttcaccctaaaatcttcaaagagccatcttaaaatgaaattcaaacctataattagcgtcaactttaagacaaaagaaattcaaccaacgagtgaggtggatgatcctataaaaggcataaatgcctcaaagaaccatcccttaaaaattgaactcgtacccttctaagacggtaaaaacacatgttactatacataggtggtagctattggatgatattacatacaaatatccattaagattaatgtcattgtcgggcgggacttcctgttggctcgcgctaagacatccttttattattttaaagggacatattcaattgccagaggtaagtttcttgttgcttgcgcactatttatgatgagtaatggcccagtgcttcagcttgtttttattctttgtagcctattattaatggctaaccagttgatgaatctaaaagtgtatttggtattggtgtttggtaatcttttaacaaaaatatcaattgttgaaagcgattttcaaaatttaaagacaatatataaaataaaaattaaagttaaagtaatacttttccaaccttaatatttaacgactcctaaatctaaaggcttatttaaaacttcatgttcctaaaatttgaaacaatttatttagaattccatgttcctaaagattcagaacaattagcaacaaaaatttatattttacaaggagaaattgatttttagctttaaaatttttaaaagcaatctccgaactgtactgaaacacatattttctaaagttataatttctttttacccctaaaatagctcaaatttcttctctttttctcccaaaagatatgaaaagatatgaatagctattagttcttgaatttactgatactatgcactctataaatctatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaagcaaaaagagtagacacatttgaaagtaacatatattacgagcgttttacactttagtattagatgattgacacataatttattatttaaaactaataattttgtatcaattatctatcgattttgtatataagtggagatatgcaccaagcttaaatataaaatttttagacaaatatatacataacttgaagttaattgaatttttatcagtaaaccattaaaaatgacctgactagtatagtcactatttgcaagtataaaatagattgtattttaattaattagatttctcctggagttaaaactaaatccggaaagcattctagtaaagatctctctcattcgaactaataaatgttgaaagtgttaatgattcccattataatgcatataaatatatagagattttaaggaaaaacctttggatgcccatgtccttcattgcctctttgatagcatcatcagtggccccttcagcttgaagttgatttaatttctcatcaaccaatcttttctcttcatcaatgtctagcccagagactccattaattgtctcgccaatttgataaggggtctcctgtagtaatcctcccttctctccagcaacataagctgagaatgattttattattttgcttataacaaatgttcacctaaatatgccctaattctttatgaaaaatgattaatggaagggagaaaaataatactcatggaaggctatcccgacgtacaaaactttaaatgttaacacataatatgtatatatatatataaaagaaaaggaacaagttggtgaaagggaatttactaaccagtagaaacatgaacaagaactttgagtctaacacatttctttgcaaagcacaagacatgcttagctcccattgtgttgagatcaagtgccacatcatatctgcatcaaattataaaagattaatataaagaaggagatcatgattatattatcattagtattattaatcatannntttcacacccaagtccataccacagcatatgtcaccaggaacaagaacaatcttttcagaaataaaagaatttagatttgcaccccatttgtcttttacaagtctaaacaagtcctgccctaatagctgcaaaaagaatgaaagaaagtacatagataaatagattaagaaatgagactgagaatttataggttctccaacctaattgcatggcattttcttatagtaataacaaaactatagagaaaatcacttttaaattgcttcaaaggggcaagtacagatgttgtcatagaatgttggtacccttcatttcaaccatcatatctttgtcttcttaatgggaatggaaaattaaaataaaaaggaagagagagagataataatcttgcttcagaacatgagtatctgtttaccctttgaaattaataattgcaataattttgtgcaatgtatatgtgtttatatatatatatatatataaatatatacctcattttgcaagcgttgagaagcagacttagcatctggagctcttaaaagaagatacaacttcttcacatttggttgcactctcaatatcttctctataaaaactgtacccataaaagagataattagtgggtatgcatgtttaatagtaaattcttttttggctaaagaaaacccattaaagcaaaagagaaagaggtgggggagagaagaagtaggtgtgtactctttgctaaaaacccagtggcaccagtgatcaaaatattcttcttctcaagaaattgaaggatacttccaaactccatttgcaaagatcaaatgagagagagagagagacagcgagagagaaagagagagagagagagagagcttttcgtgttgtgtatgtgtttaaatgaatgaacatagaagtcacatttatgcgcactagccaaaaatttactaccatttcacataagctatagagaggaagcaattgtaaattgaagtacacgctagttcttagtggtctatttttcaatatgttagttgcttaattcattattgattcaatctatagtatatattttctcaattttgcttcctcttccaattagaaagtaggtcgataaggtatttttttcacttatgaaaagtattgtatttgagttttcaccaccattcgctaattttattgaaagttttgttatatttataatgattgtaagagaatctctactcttattgtatagcacatgcataattgtgtcggttttgggtacatgtacccttttgttaaaggtcgttcgagctttttctgagagtatggcttgggttacttcagcgccgtagcgcctggtactcgaacattggctcgagggtaagcctctaattaaaaaaaaaaaaaactttacttctcttctctattttctttatcaaaactaaaataccttagcatagttgattatcacaaaagatttgatacaattagaatatatatatatatatatatatatatatatataacagagttcactgtaactagatgaaagtattcaagtattccaagtgaaacgcccaccttcaatagctcagatactattatcattttctactaatatttatatcacatgctattataaaaatatgtacacgtttttttcttattgacatatgacgtttaatttaaacattaactatattaaattttagcctaatgatataaaatgataccattttaagaaggatgtttaatattttatttaagtttctcgtagttaaaataccttaaattctaattctgaaaaaaatattaatcccttaagatgttgttagttgtttttcgatttatacatagaataagaaatataatttttttaatttaatatcattaatttgtattgtagtttttctacaatattttaattaaatttttaatagatgctactattttatagtatagaatatgaaaattattgcatgtgataatatctatattaattaatgaataatatttttgagattacttactaaactaccttctataaaagaaaattagattaaatttggactggaaaaaaaaagtatcttttggagatgaagggaatatgtggtttggcagttttccttttcataaaatgcacagattatttggttatagtatgtaagtagaaattagaccgcacaagggactaataaaatcattttaatttattataaaaaatttctataattaattttatacaatcttaaattataacatagtaacttgttattttttagataaaactaaatgactttatattctatatttctgcttattaatttctgagaaatttataattaataaatatataatatttttaagttactttgtcacagtagagtcagctttttaatcctattaacttgaaaaaaaatatattgacaattatcttccaggaaagcgttactttcttataataaattatttcatattcatgtaattaatttttatatatatttaataaataataactttatatactaaaaaatataaaatatttaatttttttgaataattacataaaattttaaaattttaaataaatataagttcaaaattagaataaatagctttattcaactaaccttttacattatcaaggagagtatttttaatgtaaaaatatgcattgaaatttaaatagaaaataaaaatattaaagtttaaattccaaagttaaatttttaaattcataatatttgtattcgaccttaacagacatttttcaaaatttataaataaatcatttaaattaaacgccgtttttctagatgcagtgtctgtctctcaaagcgaagttcatgactaagtgtagaagaatcaattatgccatcaaactcaataatagagaaaaatcaagtaaaaatttatagctttaatctacaatcaactattaatattattattaattgtgaaaaaaaatagaaaaaaacaagtaagctattttaaaaattgtgagcactaattcttttttaaaaatattacaagtaataatagtggatatcaagttagtttcaaatagcttaaatctttaatagtaaataaaattataacttaaatatatttaaaaattttaataaatttattaattatataatattctttttgtattctataaaattaacatatcccacaatttagattaatgatgtttaaatttatataaattaccaaataaaagaaaaacatatttagcacattgcttttataaatatatatagatattggataaggtgtgattgctacacaactcagcctagagtgaggtggacaaacaaggccttagggtgaggtggacaaacaaggccttgtgacattatcataaaataaggaagaccaataaatggacaaaaactagattctaaccaaaccctaccttctgatagtgataacaacatttacaatcagtgacaattacagaaataattaatttacaatcagcaaacaattagtccaaatattgggtgaggtgtatctttattaatttaattttagttataaagccaatataagtaatttacattagtgagttatctacatattctaaaatattacgtgatagaaaaataatttaaattgggataagattcttgaagtgaagtgagtagaaaaataattaaaaaatatatatatataaaaataaaagcatgtcaattataactttattttattcgaataaaattttaaaatagcaataatgtttatttgttaaaaataaacacatatatcatttcaaaaagaaaaaaaaaagaattacgtaaggcaaaaacaattatatttcaattatatgtatacaaaatagactgtagtgtttatttttttcaaataactctctattttaaaattttttagatgattttataaagttacttaatgtattataaaaatatttttaattaatttttttatatacttttctggtctctcttgattgctagactataagatatgagtgaaaaattatattgtataggctaatttacatatatctagatttgatttagagaacgacggattgttgctaataagatcgatatttcccatgattactggtgcggcacatgttacattgatatactttaatatatatatattaatttaaatttaaaaattaagtttgtttttagttaacaaataaagagattttttaaattttccatatattttcttttacatatatctagatttgatttagagaacgacggataaattttttacagatggtaaaatatttttttcaagagatttaatgcagttacatattcaaagttcaaactcaaaaatttaattaagttgaaagagattttagggtatgtggtaattttaatttttaattccagttttgtggactgtccccttcctaataggtccactgctaatagggttaggtttgtttctttttttccttttgtggattttgtcaaaatgtgtagcctattacgtctctccctgcatgatttattgtgtttctctttgtcctcacgtacatatctattgtttttgtttctctatattacatctctgtaataattacaatgtattcgatcttatctaggattcttcttttttggtctatatagggttagtgacagtatctagcatttggatcattatggcacaagagttggaaggattacggagaaattctcaactaactgatgttgagatctagttgaagctactggcagcagatgtttgaagaatcatgaattatgtttggtgggtaggaatttatcaggtaaaccgttcaatattaaggccctgtcaaatgctcttgttggtgcctggcgtttatctaagggattcggtatggaagaaattgagaacgacatgtttgtttgtgagtttcgtactaagactgacaaaacaaaataatgcatatgatggaccatgccagtatgatcgataaatgcaaccgtctgacacggtgctcaatgaatgcccattttgggtacaactatgtaatcttcccatgaataggagagatgaaggctctggtctgtgagggactgtgttggaagttgatgtttcaacaattgggtcctcgggaaaatatgttcggatgaaagtggcgatagatgtcaataagccaattctcaggggcacaatgactctgaatagtgaaggagaaaaggcttggtgttccttttgctatgagcgaatcctgaacttctgtcacttaagagtttcttctgatattccatggttgtgttttggggtggtaggttacaaactcatggccacatggataagtttagaagctgcctagacgcttgtggtattggggatatgggattccaggcaatcaaaacaattctgcatgcttatgagatggaatcaggccagccagttggtgaattttgagaaatctaaggtgtcttttagccataatactgattggcagatcaaaaaaagcaaatcttttcaccttagtgaaagacaagttgtggaaaagatttaacagctggaaagacagatgcctgtctaatcaagagatacttaactttgagttcgaaccattgttcatccattgatcgctaatacacttattttatgtttggccattgattgttataaataattatttcatgcagagtaactattgaaataaaaacgaaattattattttttaattttatagaatatctattttaaattaaatatttccttaggcgtctatcttaacacatctaagagcatttctaatgcactatttatatatgttaaactctttattttaaaaaattatatcataaaatgatattacaatatactttttgttctttaaataaaaaatagagaatcaatttggcaagacatgttaatgccacactgtaatttgttaaagccataaaaaatttaaaaaaaaaatagatttaaaagataattatattctattcataccaccttcattttcaaaattacattttaatattttaatatttttacattctactggttgtatactaagtggttaaagcaaaagaaaaaaaaaaaaacttaatgcttagcttcttctttttttctcaaattttttactatttttaaacttattattattctaaacaaaatatccaagatgtatagctataaaattattagtatacgaagacaacctaatatcatagtattatcaaattagaattaaattttttaatatttaaataatattcatctaacatacaacatgcaataactaataattgaacatagacaattaatttttaacactttaaaagttgatagatacaaatatattactaactattggtattaggacaagttttataggcaataatattaatataattattaagtatcaaaaattatatattttcttaaaatagtnnnnnnnnnnnnnnnnnnnnnnnnnnnnnnnnnnnnnnnnnnnnnnnnnnnnnnnnnnnnnnnnnnnnnnnnnnnnnagaaagatctaaagatttgaaattaaaagcatatattttgatagaaaattaacgtcatttcaaaaaatggatataattgtcttttaaacttaaactgaattgattttttgtctggccttaacaaattatagtatgccttaatatctcctcaatttggctctctacatatagatttaaatctcactctttatcttatatttaataaatttactataaatttttatatatttgatttaattaatatttgtaattttatttttcaattggtaaaaaaaattaaaattattaatacttatggaaatagaagaaaaatgtataataaagtataaagagtttattagactcaaataaaatatcttacttttatatgttaatatttcttaacatatttttttattatagaaattatgctctttaaaagaatatatttattatattaaggtgatggtagtaattgagagatgacagtgataataagtggtggttaaaattattattattattattacttaattaatcttttttataaataaataattcaagtcaataatttaaaaagtaaaataagaatgatctataaatagctattttaatttttatttatttatttaaaaattaatattctaccttatatctattctattctttaaataaaatatgattaaaattcaataatgcatccaaattaagtttaataatgaacgggggcagtacagaatcacatcatcaatcactcaagccatggctacactaagcacatgcttttgtaattgcctgaaaaatatggatattattttccttaacacaagaatttagattatatttatattataataataataataatgtcttttttaatatgaagaaagtgcattcagaaagtaaaactttgtataagtataaaaattattttatttttttattcataagatatacaataagttgtggttatataacaagaaataatcatcattttccgttcgccataaaaataaaatttcacctaacgaagagatgggcttgaattcaatggctccacttcacaaaagtaatcatttttaccacttaaccaaagaaaattgtcttatttgattaatatattccaactataataagtatatcaatggtgtaaaatccttaatctttattagtaatagttacaggtgaactatccctttaggtttttggtaggatatggttgccaactatacttaacatctatgcaagaaatatttgactattcatccaccatccttctataaaatataggcttgttgattattaaaaggtctcactgtaatctatataataagcataagtttctatgataaaagatgggtttcaactttgaaacatttttcaattctaaaagttatatattctggttgatcaaagtttggtcattcttttaggttgttggaagaataaaatttaggacaatgaccaagcttttgtcttttcttctttctttttctttctgggtctattctgttgtcccccaatccatacattactaaaaatttcaagcctcttgtgacctctaatataattagagtttttctttttcacccaatactgacaagatcaaatggattaaaaataacaaaattaaacatattgtagagctctttttgtttctctttttatcagatttaaattatttgaaacttatagataacaatcaaaacatatactcctgtcattgcaatgatccatgggttggtaagtttttggctcgacaagtaataggcatggtgattgatatatcttctacgttagcaatttcaattagtgttctacagcttttacttgttctctgataaagtgttttactttcctaaatttctttattggtgaggtcaataattgacgtgtacaacagaagtatcaataatcttatatttattacaaagatgataactcaagtaatgaactgggaaattaaagatttaaatcggaggcttctatttttgaaaacaggtgctttctttttcttttggtacttttattagaagaatgcataaacttggttcgttaacatgttatattggaaaacaatctcgcaggtttgcaataacttttataattgcactgctacttatatgttacatcaccaagaagggtgcttcttttccatcagtattatacctataaataatatggttctatggtttgcagcagtaatattccactgtatattattattattgcttgtggccaacgttataactggaaatcttttgattgattttgctaacttgaatcaagaatggaagatagcgaatgaatttcagaatcctgggacatcgaatgtgtcactccatatgcaaatatgatattataataacgtttatacatttgcttaaatagcaagtttccaaccctaaaatatctaattggaaaaggaaagaagataattagtacataatatgacctattccttcctcattcagcagctttagcacctttattatttagatgcttttactcgacagtcatgacccattaccataatacaagtatgacacacagctgcactgaagaaccaaattattattacacaaaaagttaactatgcacttcaaaaccccaagagacaacaagcattataatatttgtcgggaaaacattaacaggtgacttggttttcttaaataacagacattcagccggttctaacaagaaaagtagttacagaaaagtatgtttctaagctaaaacataaacttgagaaatatgtacattccaaggtcagtacaagcgtctgataagccttcgttctatcagacttcaggaaaatacgaagagagaaacgaaagcgcctcatccaagcttaggtaggatggtttttaggcctgtggtaaaagcatgcaaatatgcatccttacaaacgaggaaaactatcttgtttgcagacagatgaaagcatttgaaagatctaattggattgtgtataatattctacaagaaaattagatccacaacttgattacaaaagctataaatgactcaaaattcaaaatcttcgtctaactcgatgagagcctcagttacacgtctaggagcagcttcaaagaataattaaagtgatgcaccagatcctcacttgagaaggctctatagttgccaatgcctcgagaggaagctatttatgaactttatgaccaaaatgtgagcctatatccaagttcaaacaacacatatgttagccagctaatgctcttccaagattagtcctattggttagaagttttagaattcaaggaacagtatctgtagctggtgaatccggaataatttgatctgtcaatactggacctgattctacttgatcagttgctagggggtcgttgctggcttcatttgtcgtgatgtgggcagtccccttatgatctgtttcttgtgtcgcagagtttatttgttctcttgctggtcgggcagtattcttttgatctattgcagactggtcaaggtccattggattagatgctggttgtgatgtagttggttgcattggaatattctggtcgatattagtctcagcactttcatattcagacaggagatccataaactcgttgagtagacgctggactttcctatttgatgccattgctggaagtatatcttctctcaagagtttatgctttttcattccctgaaaatcacaaataggagactcaagcaatgcttaaccaaatcacattcgacttgaaaaacttcccaaagtgaatgaaaacttaacagaataaataaccccccagaggcatgatcaaaacaatgtggcttaaaaaattaacatggaaataatcaaatcaaaactcaaaaaatttagaaaattaattaggattttgaagcaacttgatatacttcattatgattcttcagatgtgaaatatttttggattacatagtaaaaaatgcaaataaacaaatattaaagaaaaaccaccattcgagatacatgctgaagaacttaggatcaagcactataagatgcaggaaaccttacaagtacataaggatcccaagccaaattcttatccgaagatgtggattcaaccatgctagtggggggtccaagaaaactctcacagacctcccgcaaacgagactcgtctgcttctctgcaaccaaaatgttcaattgttatgtacttttctctttatcaaacaaagaaagcctggataaatacttccacaaggaaggtgccaatgcaatttgcttcaatgctgcacctgtatgtggaaaataagcaatgagttcagaagaaaaccttgctaagaagcgtatgtaagatagaaggcactggcgatattcatttggggatttcaaggccaatgaggatgccaactgagcctccaaatgcgcacgtgtctgcactccatcatctgtcaccctgtaaccacccataaatcagcaaatagaactaaatcataaaattttcaataatcacacaaacagatcagatgaaaaaagaaaaagaaaagtagcgtcaaatatttggtgaaataaacactgtaacaagtaccaatacagattaaatttagcaagtccattgtttctcaatggcatggttgaaatcatgagatctaggaaatttttcagaattcagtttactctataaatggatgaatacctgctccaacctggctttctggccaaatatttcctaacatccacctgcaaggcagccagctcaccactctgatttgaacctagattccaggagctagaaaaatttgatgccgggaagcaatcgtctgctactctcagccaacacataagactcgtgtcaaaaaggaaagcatggcgtgtagccagaacaacaagaggagaaccagattttgacaactttgcagatataactttgatagttcctgaaagagcaataaaataataatccaattcagaggcacaggtaaaaatattcacaaaatcatcagaagtaaaaggacactggggctgtaaacctactgcacaagcacaatgatatattagctgtgagagagatcaaatattataagataaaaccttttgcagaagaacttggatctgaagcaattagagatgccaatgagtcctgaagaagacagttttggttgagtagatcccacacatacaatgatcccttccttgtgacaagtaacaacttccagcattcatcacaatctacaaaggtggctgcagatcccatcatcatagttggcatggcacgtctcccgcacttagtataaaccttctcaaaacatgaaccaagaaagggacatccggtcaatttatgaactcagcgctcaatatgaaaaatatccccataacaaaagacttcaaaatcttaaaatatgttcagaatgtagtacaaacttcattaaattcataataatctctatccaaaatgaagcaacagccattcttctagcaaccaatgtgttcttctttttaagaaaatgaaaattttaaaatctcaaaagtaaaattcatgaaatttctgaaaacgaaatataaggaaacacgatttgagagtgatttaaagccaattccacaaatgtagccagatcatcataacattgggattcttcccgtttgatcgactaatcttacaaagagcatgaaataaccaatgaacatgtcattcttttccatcatttttgaaattctgtattgcattcttttagaggagtgtattgatttttccaattaattaagaagggttcctgctgcccatagcattcatgatacagctaaatttaaggcaaccaatattttttccgctttctgcaacactcctgtaatctattaagaactgcatatctcttctcagtacagaaaatttgtaaaattgattcctcttctttctttggctttgagaacagttcaaatgtaaaattcctctctaagaaagatacacttgactgaggaagtatgaaactcaattatttacctgtagacatccatcttcacatccaacagcccagaagtttgcatttccagccaaaactgtgactttcccagagatcctatcagaccaaagagtttgagccccttttgtgcaaacaacttctgtttctttcatcatacttgcatttcctaccccaattatatcatttacagcatgttctctagaacgagcttccaagcaaattggtacagtgtcttcacctacttttttatcaaataccctgattgaaagaggcatagtatgagaactggaggaactggatgccttcacgctcccagactgttctacattgatactaccatctctgcttgaagaacctggaactttctcaatgaccaaactctctgtgatggtagcccgggcagtgaccccagaacgatctttcaagccagagcttctaacaaatgttccccttagagaaccttctggccggccagcatctgcaggaaccaccccatttacatcttttccttgagtagatgctataagaggtaagtcaagtgcttgagactggaccccaccagtaactgtttcctgctgactgggtacgcctacagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctctttgtttcacaggactagaaatccgagcagacgtagtcactttatttaacccgtcaccagaagttccaacagccttcttcccatcatcaacttgaggctcagaagtttttgttatagcctccaggtcaacagaagattttgcaggcatttggttttgctgagtgtctaagaccacttttttagtcactgattgcttggctgaagctgcttcaagcaacagttgtgctgggctctctgccaagtttgcttgtcgacctctgacatcaccatagcgacttctctttaactcatcaagctctgcatcactaagcctgtgcccaatttcttttatttcgaaatgaaaagtagcaactgtcccatccaaggaacaggcaaaaagtgaatacccatcaggactcctgtcgagggaacagaaataaagaaaatcacagaaagaaatatataaatgggaataaaattgtacaaacaataaaaatgcacaagtatataaattactagaaaagtatcatatttcggaaatattgaagtttaccaggacaaatctacaacactttgagtaaagaaatgctttgccacaaaaagaggccgaggacttgcagttgtccatacagttatagtgcgatcctgactcccaattgcaataacattatatggctgtgattctttccctccaatcttagaggccccattagcccacccaacaggcgcacttttcacttcctgtgcatttgcagaattccttctaaacattgaatgattaaacttcaccacaataatgggggcattgtgtcctaagaaatcaaatgtggcagcccattcccctctctctagaactggggcagaatgccttggcttctggaagccatgagtggttgttatgaaatggccacatggggaccatccaagtcgcctaaaaaatgtagatcccagctgaaaaatgcatgctcctattaataaacagaaaacccaactggaaaaatggaaatttatcaacaaagagacaataacatacagattttgcccagtggccatcggttctgtgagccagactccagtcgctcgtccgccatataatcacagtcttatcgtctgattgacttgctataaaagagccaatgggatcccaagccacccccttaaccaggctagagtgacctcttagaacagctgtacatattccattgctcatattccaaatatggatagtattgtccaaactcccactagccaatgtggaatcatctggagaccaattaagatccacctactttaagcagtgaaaacaacaccccagttagacgatacccagcaggaaaaccagagattaacattattggagaccaattaagatccacctactttaagcagtgaaaacaacatcccagttagatgatacccagcagaaaaaccagaaataacattatgaaaaaaggaatataaactcaaatataaaactaaatttctttattctgattctggtcattagcttatgacttagcatttggatgcaatcagaaacttcatagggacctatctgcaagtcacaaaagacacaacctaaccagttcctatttacaaaaggaaaaacaaaaaatgatgacatgcactgtgtgtgatccatgcagtaaaagttcaaccaagaagcaagactcaaagaattctcttttatttcatgttcaagcatcacagtataacagcaatttcattaccacatctgcagtgtgccctctcaaagtcattgcaaccttccagttctcaacatctggcggctctccactaccaaactcagtggtgcctgaaccaggcttcctttcatgaactaaaatcacctgatcatcagaacctgatgcgacatatcggccatgcttagcccacctgacacaatttactgatccaaaatgatcacggagagttgcaagaagcctctgtgttggttcattatctgctaagtccctgctaacagatttcatgttccatattcgaacctgcatataattcagtacaagagaataagtataaacagtaaactaatttcatcacacaaattgataaatgtaacatactataagtagcattacggctaaagagatacataaagaatagcaagttgattttatcaacttagagtgaagctaagttaaatggcatttttagcttgaagatcaattatcccataaattaataacaaacttaccaaaaatcataaaatgaaatgtgagaatagaaacgcgaccgccaaatatataaaatatcacatacaatgtatagcatactatgtgtacttatttgcagagggcttacatggatagccacaggatggtaaaaaaaatttaagcaccaccgactatggatataaacaactcaaagacagtactattattaattaccattaaccataaagagtagtacacaattatgcatgatctgaaacctatactcaaaaagaacaaccattactgctttctcatatcatatctatgccaccataccaacaacactaactgaccgcaactcagcaagatgtataattgcatacactctaaagtttacagtttctgaaatgctgaaactaacataaactgctttgagaaaataattgacagaataaaggttcgagaattaacatttacgcacaaccatttcatctgcaatttcacgattgagttctacataatagaccgtacaagatttcaaaacattgattatctttttctgcttacattttctaaacaattaaataaattatgcatgctgacaaagatcccaccaaccaagtcgtagttcactcattaagtggaaaggtttcactacccaaaatctaattttatcagcaaccaaaacaatcatgaagaaacaaaaggcaagcttcgccagctagtggcattgtgcacaatcaaaagggggttttgcattttgcttgcaaccaaagagaaaaaaggaagagaaagtgaataataccttgtggtcacctccaccagtagcaaacctgagagcaccaggttgaatgtcaatggagaaaatctgcattccttcatgtttaacccaactgggtttctctgcaatcatctttctttccttttattttgacccaaaagagcttcttttgtacttctttcctctaaaaaccccaaacggtatcaaagctcatagctttctggaacactaccaacactcaattgcactatgacaagaacccagtttacctattataaattgtaatctataaatagttccaaaacccagaaatagaagacctataagaacctgagaccagtggaaacccagaccaggaaaagaaccaaagccctacaaaaaaaaggtccttttagcttagtactttgataacgctaaaagggtatacaaattcagggttcttagaacagataccctaaatttgagaaagttacacaaaataaccaaaaacaccaaatagattgattgccccaagaaagcaaattttaattattttgcgtaagaaattgaaagatttcggaagtagaaaaaggctaaattgcagtttaaaaaaaatatagaaaaagccctaaagccctaaattagtagtaatagaagaaagaaagaagggttttttataaatttttattaaggtaattacagagtattttaacgaaagaaagtaactctaaataagaaaattaaaagaggagaactctgcttttgaacggtccaaatctaaggctacaagattgtgtttgtgtttgtgtttgtgtttgtgtatgtgtgtgttgatgggtttttttctttatggaagagactgcaagaggaaattacagagaaaaagtaaaagaaaagaatcaaagttagcaaaaacgtaaagaataaaaatgggttagattcgaaaaggacagacattaatgggtttatgattttattagaaatggaaatggttaagttgtaataaaataggctttccttttaataatggtttctccaaaaccattggcattataaaagtaatgagataataaaagaagactataggttaaaaattacaaacagaggataacttacagctgcataactcttacaatgtgaagaattagtttgttaggtcaatctaagttcccaaactggtgaagttatgaataagagttgaaatataatagcatctggttttcaagttccttccatgaagtataatagcttaacttactagaactaaaatcatacctgatactctcaaatgcagtaataattcaatttatgcaaacaagaaagtaagatagtgatataatataaaattacttataaagtagttcattaggcatgagattaatgaaaaaataaattcataattattaggtcaggtattttaagtcttattaatgaaagtagaacatttcttttcttttcttttttttcttttttttttccttaaaaattcggtgaaaatcaattactccacagtccatttccaaagttgaaaactttactgtcttctatgctgggacagaacatgatgctaatgctattgctctactctctagggcttttgtttcaactttgaacatctgaggtcatttttaaagaaaaagggatcgcacatgctcagtactaacagttaaaagaactcactttgttctcaatctcttaaactgaaaaaagaaaaaacaagaagaagaatgaaagcaaccaaatgctgctattcattactcaactttataaactaaagaaaggtgagatgactcgaacaaacctcactttcaaaacctttacaaaaccccaaccaatacaattcttgaaaactaccagaacccagtttttacaatcccatgctactgccgtaaacctgggtaaacctttacaggaacctaaatgctcaattgcgcagaatgtatttgatagaagtccgaaacaagacgttgtacagtgtaatcacttgctttttgactattctcgcaataattctcaccatgaagttgttaatctcttcgtggctattcatcgttctgatcttttaactgatgggtctaccctttcttgtgttctgaaagcttgtgcttgcttgtcatgcaaaaagtttgggattcaggtgcatgattattgtgtaaaatctggttttttggaggatattagtgttggcacatctctcgttgacatgtatatgaagagtgagtatgttgaagaagggaagagagtttttgatgaaatggaagagaggaatgttgtgtcatggacctcattgcttgtcggttatgcacataacggattgaatatggaggcattggaatgcttctttgaaatgcaagcaggagccattaagcctaatccatttacatttgcaactgttcttggagctttggcagatagtaaagctatcgctgacaaaggagttcaaattcacactatggtaatcaaaaacgggtttgaagcaactatctttgtttgcaattctttgattaatatgtactcgaaatcaggcatggttaaaaatgctaaagctgtttttgataatatggtgacaagggatgctatcagttggaacagtatggttgctggctatgtggcaaatggactttatttggaagctattgagatgttttaccatctgagacttgccggtgtaaagctcaccaatttcattttttcctctgttatcaagtcatgtgctaatatcaaggaattgggttttgctaggcagctccatggtcaggtcctgaagggtggatttgaatatgatcacaatattagaacagcattgatggtagcctataataagggcagagaaatagatgatgcttttaagatattttctatgatgtatggaattcgaaatgtggtgtcatggacggccattattagtgggcatttgcagaatggtttggcagagcaagctgttaatttattttgtgagatgagcagggaaggtgttagaccaaatgattatactttttctactatccttgcggctcaaccagttgtttcgccttttgaagtacatgcacaagtcatcaaaagtgattatgagaaatcaccttcagttggaactgcacttttggatgcttatgtcaagctaggaaatctcaatgaagcttcaaaagtgtttgaaagaatagatgacaaggacattgtggcttggtcagcaatggttgctggatatgctcaaactggggatactgagggagctgttaagatacttatccaaatggcaaagaaaggggttgaacctaacgagtataccttctctagtgtcataaatgcttgtactgcccctacagcggcagtagaacaaggaaaacagtttcatgcttggtcaatcaagtctagatttaatgatgctttatgtgtcagcagtgctcttgtcaccatgtatgcaaagagaggagagatagagagtgcaaatgaagttttcaggagacaaggggtgagagatttagtttcctggaattcaatggtctctggatatgcacagcatggccatgcaaggaaggctcttgaggtattcaaggagatgcaagaccaaaacctggaattggatggtgtaacattcattggtgtcatttctgcttgcacacatgctgggctagtagatgaaggtcaaaaatatttcgatatcatggtggaagatcaccacattgagccgacaatggagcactattcttgcatggttgatttatatagccgagctggaattcttggaaaagccgtggatgtcataaatgagatgccatttcctgcaggtgccactgtatggcgaactctcttggctgcttctcatgtttaccgcaatatagagctgggaaagcttgcagcagaaaatctcatatcactccagccacaggactcagctgcttatgttctgctatccaatatatacgctgcagctggaaattggcaagaaagagctcaagtaaggaaattgatggatgagagaaaagtgaaaaaagaagctgggtatagctggattgaggtgaaaaaaaagacctattcatttttggctggcgatatatctcatcccatgtcagatgaaatttattcaaaacttgaagaactaagcagccgactgaaggatgttggatatcatcctgatactaattatgtacttcaggacgttgatgaagaacacaaggaaactattctttctcaacacagtgagaggctggctattgcttttggattgattgctacacctgcaggtactcctctccagattatgaagaacctaagagtctgtggagactgccacactgttattaaattaatatcaaacattgaagagaggtatattgtagtcagagattcaaaccgctttcatcacttcaagggaggtttatgctcttgtggggattattggtgagaactcattgatttgcccgttaaattgaaacctctggcgcaatgcttagcacatcaaaaccgccctcaggatgtgacccacattgtagttatgtgctgtaataagtttaaccgagtaacacaatcagtgttatgcagcttatggaaaagacttctgaatcgctcagcaattgaattgtttggggtagaattcttgtaatgacaatgaacatgatggcgattcatgtcaaaaagggcattaaatcaagtattgaacatatagtgagaatcataatttcagcagacaggtaaaagttttggaaacttagagacatggtgcataattttagtgattcaaagaaccagaaataaccaaagaaaatattcgagttattctttccctcttttgttcacagtttttcttctgtagtcaattttgtgattatttcaataaagttttagtaccgtttaaacaaaaatcttagcacttgatatatatagtcaatttgaactcattttcaacagagcctaatgtaagattggaggttccaggagcaacatggtgggaaaaccgaatttgtgctaaaagcctgaagcagaaacgggtattgcttgttcaatggaaggctccaatcaatatcttagtttcagagtgattactacatagtttgaggagggacgaaccaagtaaaagaaggaataaaagaccttcataaatggtaatgcctggcacggtaagaatgtcagcatcaatgcacaggtaaaccgacaagacttggcgatgggaagtcgagcactgatagaaagcctctagggatgcctttagatctaataacctcacattagctgacatgccaatggtccagctgtggcctgttatatactatgtttattctttggcggccaattatatcagtcagactctgaagaaagaattgccaaaagattaaagtggtttatgcagtgttgaattgtgttgtatgttcaatatgtgatcaagtcttgaccataacattgtaataccatttatgcaaattaatttggttcagtgtctttctttttttattaattgattcagttaatttgattgtttgtaaaatctatacaatttcatttgcttctgttaaaatgaagtaatatgtgatgaagttgtttttattgttgtagaattctgagattacaatgtttgatgatttagtatatatacaagatgtacaacgatagcctaatctatactggttgccttgtaaactgtgtccaacgtccctttctgtttagggaaggtcgaagtgaccactccctgtcacaaggatggttgctcccttttcttatagcctgtgataagtagccctgcacaatagcctgtgatgagtagccctgcacaggcttttctgcctgtgcagtgtttaaggctatcttttctgctttctttagtctactgtcttcaacactccccctcaagatgggttcgtaaaggttaattgaacccatcttgctgagaatgatttggtgactatttttattgagagcttttgtaaagatatcgaccagctgatcttggtttctgacgaatggtgtttcaattttccttcagtgtactttctctttgatgaagtggcagtccacttcaatgtgtttggtacgttcatgaaacactggattggatgcaagatgacgtgctgcctgattgtcacaatacatcttcataggtccattgcatccaatttttaagtcctggaggacttactactgtcccatcactcttatattttatcttgtatacctatttgcaccctacggttttttttgttggtggtagaggcacaatgtcccaagtgtggtttttctctagggcttgaagttcttcttttatggtctcacaccactttggattggtgttggcttcatagaaggatgtgggtttggtgtgagctgtaatgttgcttaggtaggtccggtatgtgcttgagatgttatcatatgtgatgaagtgttggattggacacgataccttgtgagacacacagtctcgaagttttgcaggaggacgagtctatcgagtggatcgtctcaaggtaattgcttcttgagtagcttcaaatccatcttctaagccggtgtgatcacttagatatgtggcagtaagaatggcatcggacaatagatattagggacataattgtggaaaagtaaagtcctaatgactttaagaaggtggcgattttttctttcagaaacttcattttgttcgggggtgttaatgcacgtagtctgatgcaaaataccattttgtttaaagaaatcagtgaaatatttgttgacatactcagtaccattatctgaccggaagattttaatgttggtatcatactgattttgaataaaaagaaaaaattcttaaaagcaaatgaaaacctcattttttcctttaagtaagaaaatccaagtagtgcgggaatagtcatcaatgaatgtgacaaaatatctgtagtgatcataagattcaacaggggcaggtccccaaacattagaatagattaattcaaacggtttggtagagacagtggaagataaaggaaaaggcaagcgagtatgttttgaaaatttgtacacatcacagcaactagaattcaatttataataaaataatttattcaagatagaatcagatagatgcccaaaccgccaatgcaacaacatgccttgattgacaatgggagaggctgtgaggcattggctggttgggttgataagataatacagccctttttctagttgcccttcaccaatcgtcttcactgttactcaatcctgaaattgcactgaagacgatgagaaaataacattgcaatttaaatcacgagttaatttggcaacagacaataaattggatttaaagtcaggtaataataatacattatgtaattgtttattaagtagcatggtagtgccttggccataaatagtggccttatttccattagcgactgtcacatgttgagaatcagcaatgggtgcaagaatttgcagattcattggattccaggacatgtgatcggtggctccggaatcaatgatccagtgattattttgataaaaatttacagtttttagagaagagtgagatatcgaacctgacctatttgactgctgttggaccagggcttggatttaggacagcaaatgggtgagatgcatgttggaaattgctgggtcgggttattgggccagagcagatggaccgggttgggtcagggcagaaaaatcgggtctggtagggtagttttcaaatcccgcataaaattcttcacatatacgctttccattagagtttttttgcattcttcttcttcttctctccccaccgctccccctagctgaacctcttctctcactgccgctccccctagccgaacgccacttccgcctcgccttgctactcctctctcccatccccgattgggttttagctcggggtgaaggaaccaacaggtgtcgcgatgatgaccctattttttacagtggtcacaccgttcgacgctgctcggttctccccttggccgagccacgtcatgggcagggaggcgtcgagtggagcaggcgcgattgtcggcagtttcgagtgagggagaggcgttcataaggcttcggcaagttttttctctcgggatgattgcgattgcggcatctatttttggaagctcggtcgacagaaggatttgcgatctcaagcttacgtagcttgagtccaatcctcccagttatgtgtaaactagatcttgttcggtctttttttggatttcttgtgaatctgttgtcgggggtagttttgaagctcttcctatctggtaagaatttctgtggcatattctgagccacttttcatctcttgagtgagttgtgcaagttcttgtttaaggttgaatatgtgtgcgaagttctgttaatgcctgtataatcattttacttttatccatattgcctctgatgactctaacagcatgcataatcttgatatttgaggctccatggtgtttgttaacattgatattaccatgtggtcattggtttgccattcttctattttttctgcttcttctttggtcggggcctctggtctcattggtttgagtctgggttttgtcttgtgacaaaccatagtttcctcttgccactgaggccgatgtaggcagacttcgaccattcaaagtaattttgatttcctttcaaaattacactggttagtttgctgtcgttttgagacgtgatgaacttttggttctgagcagaaatggagttggtttttgtttgctttgattgattctttacaggtttgaaacctgctctaataccatgttaaaatgaagtaatctgtgatgaagttatttttattgttgtagaattctgagattataatgtttgatgatttagtatatatacaagatgtacagcggtagcctaatctatactggttgccttgtaaactctgtccaacgtccctttctgtttagggaaggtcgaagtgaccactccctgtcacagggatggttgctcctttttcctgtagcctgtgatgagtagccttgcacaggcttttctgcctgtgctgtgtctgaagctatcttttctgctttctttagtctactgtcttcaacagcttccttacaactttcaatggatttatatatgtgatgtatccggaaagaggattgtttttatttcctagtagcagattagaacaagaagattagaatcaagcggtgaaaactctgatgcttcttgtgatttcatagatgctttttggaattcatagatactatctgcttaaagtacataattcatttctaaagagactttgtaagatctagaccatgaaagtttaaatgagctcacctaaatggccttcagaaaatatataatgtaagaaagagaattttctctgtaattccctgagctcaacttttttctctaattctctctcgttttcttctgttttatgggctaccagaatgagagacgaacataattccaacacaatcttttgaatttccattttgatatattagatgattcaggttttttgcaagaatatgagctgaaaaaaaaattaacaaaaagaaaagatgtatggagtcatgatgaaacaacgaacaataaagaaagaaattcctacgctttctatagagaaagaacattaagtacaataggacttctaacctcatggatgccattgctccatgttaatgccccaaatacaaaatttccattactggttttaaaaggtacaaaatcaatcctgaaagatattttctctcctgtccttgtaaacttgagtgtggcaggtgtaactgtaactttaacaccgcttggataatctatcttagcagtgtaagcagttggtcctttactataataagtaactgtcctacgaacagacacacttccatgcatcttggacacaccgatggaaggatagttaaaatcataaggttgcatgttaggcttttgacaataggtagattgtcctgtcaggtttttcaattgtgcagggctttcacctgtactgcacagaaaattagtaacatcataggaattgaagtcgtaaactagtccaggattcactgctgctattgggtttaggtgtcctgatccgtagtcaaaaggtgaactctgtgtgccattcggatatcttccaatcacttttccagtgttatctatcactgtggctatagcaatgaatagaataaaaagttatagacgtatacttaataagcttaattggaaaaattctgacgagattttaagtgatggaaactaacctgttgtcataattgcagacattattgctgctggactccaagaatttttgtaagattttaagattgcggcaactgctgcaacatgtgggcaagacattgaggtgccagagattatgttatagttggctgctcttccacctgtgccaccagttgctactggagaccatgctgccaaaatattcagacctggtgctgtaatatcgggctgcaaaggaatttacatggtcacacaaatttaccagtaattttcctttcttgtatctacctgaaatagtcatctgaaaaagaacaaatagagagaaatagggtagaacttactttaataatatctggagatattatatttggtccctgagaagaaaacacagccatttttggtgcaggcttagtgttcaggattgttattgttggagctatcctcgcaattggatacctgtcaaaatttaaaagatttttcttcgttagtctaattcttgtcttgtattgacgtattatgtaagccggaaaaagctttagagctcacttttctgtcttcatgtatgctagaagctgttgtgcttcttcttgaccaattagagtgcctggaattacaaactgaaagccaacttctttggccgatggatcaatcagtatcattccaacaccacctccttgttgtatggttaaggccttttctccacggctatctcttaccacctcaattgtgcacaccacaatcttccccttaatcttggcagggtcgagggtgttgttcttgcaaaagctgatagacaaagaggcaaaaataacactattggaacaaatcttggatctgtaacaacacaacttcgagacttctactctcaagcactcatcaaagtttcatttctatctgaaactttgattccagaatcaaaaataataggaaatgtaccttgcattctttgcaggaactccggctgctgctgcatcacttccagctattaaagcatatgaagtttccattttcagagggttcaaagagaaaccctgtaaaaagtcgtaaatattttcttgtgagatagtgttaattcaacatatattgtagttccataaactctctttcttctatttttctgaacttgccaaaattggaatagaaagtctaagactgcattaataaaaaaattaccttgagaacttttgaatttccaagatatactacattggagttgaattctctatccagagagctagcagcaacagtgagaatccaaggagcaacattggttgcagttcctggaaaaaatgagtttcctgcagagcaagaaacaaatactcctttcctgaaagcatggaaagcaccaacagaaatagcatttccaaagtaaacaggctggggaggatcagggccaagggaaagagagagaatatctactccatcattaattgcatcatccatggcagaaagaacatcagcatcactacacaggttaaaccaacaagccttataaatggcaagtcttgcatttggtgcaccaccccttgcagttcctcttgccatcccatatagactagcattagtcaccatatttccacctatagttgaggcagtatgagatccatgaccatcgctgtctcgagctgatcgaaagaaagttccatcaacattttcaagaggcccaatttctgcctcaaatcctttgtagtagaaccgtgctccaatgatttttctgcaaatcccatccattctcattgtaggactcatgattttgttatagatatcaaaactatttttcatacttcacccaacaccttaaagatttaagctgaatggtttttgtcatgacatcagagccttttgcaaccaaaagtttcagggttctttggcctttctgttcccattctgtttagtgaaagaactcccagaacaagatatggcctaatggctttagtgtgcaggggcatgttggggttattaaaacacctggtttaagcctttagttggcttgaattgttctttgaaagaatcatatgattattttccatttgcaaattagtttggaacaatttaaattgatatatacctgttgcagttagctgatgtaaaattttcaccagcaacacatgctcccttgaatttcatgggcacagggcctaagcctgtatcaccaaaactctccgactcaggccaaactcctacaagaaacttcctacactgtaagagtgacaaaatgaagcacataagagaacccataaagagatcaaaatgtacatcattaccagtgtcaatgacaccaacaataacgtccgatgatgacgatgatgaggccgtaggaagtttattagcataaagagagttcactccaagaaattcccatgaatgtgtagtgtggagcttatttattctactctcaaacacagaaacaactgatccactctctgcctcgaggatacaatgaaataaatcagttccataaagagcttgctcttaagatcaaatgttgtaacataccagtatcattacaatattacctgcaagtctctgagcttgatcttgtgtaagcatagcggagaagcctctaaagcttttggtataatggtgaaatgctacatctcgtgcatcttcaagactgaaaattggaaataacattaaaaatgtcattagcaggctctaaggagagataactgcatatcagcatgccattagcatagccaagagattccctggttttcatgcatatatatgtatatgtaggtgtctaacagtagtaaatggaatataagtagaggcttgccttccagtaactgaagaaagtatcctatggttagctttgatgacagattctgaagtggggtgagagtgttctcccatgtaaacaatgtaatgctgcgacattgacaggaagcataaaaagaaacaaatgaatccatggaaaaagcttatggtgaactttggtgttggtacttaaaaaggattgttattcagcaaagcatatgctcattctgcagaaagttcacatcattctgatgatggtggcgaacgagcttgctgaatcatttcaagtactatgtaccataactcttattacaatgggacctacctttttgttggcactggcgccatgtaccattgcaattgtatctaacaagagaagagcaagtattacagctgacctcatggtgtgttagaatataaatgattatagggtctaaaatatatggagaaactcatgatcacagatgtacccttttatagccatatcaaaccaattacaaatcgactatatgtattattaaaaccggcttgtttctgtattgatttagaaagctgcatatgtaggctgtaggcttcaaaaggtatataaatgtggtctacaaatgttggtggtgatcatataattcctttctttttggttttggaatctcacagtattttacagatcaatattcgtaaactattgttaaattcagcttgttgatccaattgagaaaaataaatttagaggtccagtcatgctttgacataattcagagtgctgttaggttggtatttttgcttgagagaattgagaagatctcgagtttgaatctcttgataatatctatcgaagttaatcatgcctatggtgagggataagagatgactaccccatataatatgttaacggagcaaattcacttgacacattctaattgaagccctcttggccggcttctgttaataacatttttagacattaacgaagagtagatttggcataatccaaggaactatttctatgtattggatttatatagttggatggtaatttgaagcacaaaaagatgtgcacacacttatgccttattagtttctaaaggttgatacttttacagttgaatatatattagaaagaagctaaaatggcacctcagtgtatcttattttattcgcctctgtattgtttgaactccatggacatacacacacaaagaaattatactttctgagacccagtcaatatcgttttgcttagccacttgcaagaagatgaaggaaggcatgaagttcaaattttgttagagatcatagagaatctcattactgtagttaaaaatcaaaccataagcactatttataagagaagaaaataccaaaactaattattttaagtattaaaatcgtacttaacaatcctaaaaaaaaaaaactatctatttaagaaaaaataatacagtgaagcagtaattctacattatgaaataacgcttagttatgaaccttacataatttttacgaactatcatgcagttttatctttttagttgttattttatatattgcaaaatgacaatttcactatataatctctcattataatagttggattagtatggtgtatttgtttcctttttgccttattgccaaaacttattctacataagtatattgaaaagaccaagttatcttatattatggagtttcctgagtttcagttttgaaaagacaaaagcaatgttggagggaaagcttctgaaatagaaagaatcatgaataaattaatagatacaggaattctaaagacttcactgctataatgttgttaaaagggcaaaaaacaacaggagaaaccctacatacagatttagatttaagccatgacttggtccgagattcaaagccaatcagtacttttcatcatcatcatcattcattttgagattagagattattttggaacgaatatagtatacatgatctcaatatcattcaatgggaaacatcactcaggatattttcattcaagagttaacctgaaaccaagctaatgggtacagacagggaatccattaccttcatcctttcgctgaagtttcgaataattccttttcacgtatcatataaactttatttaacatgctaagtcacccttgaaagcattaatttttttggtggactgaagcatttatttttcaatagctttattgggcattggaatacaaggaagattagtaatagaaaggagacaccattcattagtttacttcctatggaaattcctttttcctctttccttctcgacaagtaaatccgcaaagggttctctttattcatcaacagttcttgacaactccagagaaacatcttcaaaacactttgaaccctttaattttgaatagaaactctttttttttttttctcaactttaaaagaattgaaaaaattaaataaaaatagaatatatatatatatatagaacatgttgactatgaaattattccagcaacacctgaaaactccagaaaaaacattgcaaataagataattagttggcaattctgcaatgatatttctaagaactcttctttacacaatttcaagcaagtaatttaatgagtatccaacttcagtttttccagctcaatacaaagggaaagtcaagtcagcttcccctttttgatgaagtaaaataactcattggatccagcagcaataactaaaatacaaatcatagcaggtgaactcacgggtgtggattgatcatttcacaacattgattgattaaccttcctctccaaactcctttgtgaatctctcatgaacctcgagatcagatttgctgacagttggcctctgtcgtgcaaggaccttatcaaaatctgtttttgtgatggggggcggaaggatctgcagacacattaatcagaatcaagaagagttctcattgttctaatgaggaacaaccatatgacaaagatgaaaacagtactgtttctgtatctaaaaatctctagttcattcccccatcgaaatagttagacaaacagcaccggcttattctaacacaggagattggatgatcttcttccttaaattcacataatgtattgaaggcatatgcccttttaccttggcggcaagcccttgtgctgctagctcctgcatggaaatttggacagcgcctggttgctttggtccacaaggtacccacatatcatttggagtcttgataaaaaacatggcatcctgggttttacgaaccggctcaaagaggacatccttcacctgtcgaggtcaaagataaggtattaaacatgccttcataagataatagattttctttttttctttttataaaaaaggggaaaacaagaaactgaaatattgaacataaaggcctcgtacttacacaaactgaaatatctgaacccgaaaagccttcagtcctgcgagctaagctttcaaaatcactttcagtcaagttatgaggggtgtctccaagatgcacctacccaaatttcgtgaagctcaaatcaatattatacagatggtcgcatagctaaaatcttaagaacgtggatattttaagaaataatgttagtactttgaacatatgctgccgagccttcaaatctgggaggggaatatatatacgcttgtcaaaacgtcgcctgatggcctgtaatcactattgattagcaatcatgccaaaaatttccggtgattaaaaactaaataacaaaacaaccttttcataaagtcctcacctgatctagagcatatggagtgtttgttgctgcaagaacaagaactttctggtcattgttccctacaccctaaattacaagacaattaaggcccacttctatttcgaataggatatatacaaaatattcatcaaaggcagactttttctttgaccaggtaaaagcaaaacttaagaactatatattacatttataagaactaagttggatataaagaatattggaaatcagaagccgaccacaagaacataacaatgcaacagtcagaagcaaacttcattgaattgaactagagagaaaggtttctacagtttacttcaaatgacagtaccaccactgcaataaagtaattcaaaggtttagaatattcagaatatatctatggcaggcctacacagcattccaatttgcattagtgatcgaaaagtaccggtgttcaaacattgaaacacatgtataatcactgccagaaatcccaatctccattcatagatttaaatgtgaatgttaatttgtatcaccaggataaattaagcaacaattataatagtttgaaagctgtaagaatgttatcaggcctttaacaataggaattccaaatttccaaatatccaccagggttctccgaggagcaaccactaacacaaacaactatatgtgtatataccaaacttgatcacagttgaacttctaactccttacccttttcctggtctgattttaaaaacagatgagttcaaaaaaattgttgacagaggcacctcaacacctaaaagaggcgccgcttaccgcataagataatttaggctaaccaggttcccaaatagaattccttctaaactcgggcctaatttatttcacgagaaataggcttaagaaatcaaacttcctaggaagtatgcaaacgttgtataatattgtttgcaagaaagaagaaatcaagggaagccaaaacttctttttggttttttcagtaccatgatacttaccagcggaaagtatcatttttaaaaaaagtgcaatttcatgtttgggaaacagggattcggcaaatcaaacttcctgagtggaaagaagataagttacctaaaataacattcaaatttttacctgaaattaatgtacatttgaaatagtagagatagaatacatattccaatctactttttaagaatgtggtaatcaaccaaacaaaaaaatcagtgcacttccttgaagaaaatttatcaccaaacactaatagttacaactttatagtaaataattcactaccaaaaatctgctaagagatttcctaggcaataagcatgcttgaattggacaaggcttgtccgcatgtcatataccttttaaattcagcatcaataatatcactacctgaacgaaactagatctttccacaactttttttaattcctcccaaaggcatggtgacaacaaagttgattttataagataataagcagaagtcattcagaaaaagctaaaatggactgcaggtgaactacaagcatttttattagcatgagaaaacaaaaataatacatgctatttttctttaccactaaccacaaaagggaagacaaattatacctgcatctgaacaagaagttctgtcttgatacgtcttgaagcttcactctcattaccttctccgcgttggccacacaaggaatctatttcatcgataaaaataattgaaggctgactttcacgtgccatttggaaaagatttgaaacaagcttttcactctcccccatccactttgaaaccagatctgatgaagaaatactattgaaaagaaaaataaaaagaattaagatccagcaacttgcggacaagtcaaaatgaaaaggacatcattaaagataaatgcaaatcaaaataatgtttctaccaaggaaatagaaacatggaagcagtgaagaccatccccctcacccccaacccagaaaaatgtacaaaaagtgcaagatggcatgagtaaaatttgatgaaatgtgaaagctgataccagcaaaattagaagcattttccgtgtggtgtaaaaaactcacctgaaaaatgtagagtctgcttcagttgcaactgccttggctaagtaagatttcccagttccaggtggcccatacaaaagaaaagccctccatggtcgtctcttccctaaaaaagaggaaaggagggtacatcagttttaacagaaaaacaccaggcatgattttgtgtaataacattgattacgaagtaaaaatcctatcaggaatcagaatagctacatgcatgacatgctgatagatttcttgttaaggaaaacaggtttacttaggttacttaaggtaaactgccacattcagcatttttcatgagcaggatgaaaagcacctgtataggcaatggtcaatcacctataggtacatatgctttacacttgctcatggttgaatacattattgctaaccaacttgaattcaattcctgagcacccagccagaaattcaaaaacaacaaaaccaacaaaatggaagtcaataaattccaactttggaacatgatctatacaatccttacggagtatgaaaggaaataccaaagtccagccacataaattcaagatagagaaaacaaaataaaataagaataatccagcatcaatgaacctgccatggaggtgtccaaagagactgcagcggtagataagagaaaacttattagtgacaaatgattgtaaaggacacaagattttgatgacttcctaataacccaaaggcaaagccttccataaaacttaaatcctactgctctcctggcatgtttgtaagtcatatacaacaggcgaaataacacatgaactacaaaagctttaccaacagaaaattgaagtcaattacttgatttccaatccagaattgccaaaagttcactgatttctactcccacaaggccacaacaagtaaaacataaaatagctcaatttattttttcctcctcgtttgcaattttaccatatgagctcaatgaactcaagaaacaagccaactccaagaacaaaattgctgcaacttaacccattctaaaaccaacaattgcacagctttcaaactcattaatctattcacttcagcaaacgaaattggaagctaaatacttgcaaaaaattaaaaataattaataaaaaaaaaaaaccatttcacctgtaaaaaactgaggaaacttaacaggcaaaatcacagcttcctgcaaagcctgtttagcactttcaagccccgccacatcattccaattaacattaggcttctctctaataatcgcagaatttaatccagctctcaatttcgtttgctcgggatcctccccatcttctccatctttaggtttagtcttaggccgtgtagcaacagccgcatctccattcgaagcaggcccaggcccaccttcatccagaactgcacggatctcctccgctcgccgaagatactcagtaaatttttgggttatagcttcgcgaatcttagggttcttttcatatttcaaatgagttttgaagtattcaagtgcgttcatatataaaggaaatgcttttgcataattaccagcgttgtcctcttgtactgcttgccgaacatactcgatggcttgctctttgaaattgctatacattatttctttcgatcaattgacagaagagcgcatgtgaagtcttgaggatagattggagaagattgagatgaaatcagaaaccctaaaatttgaatttcttcttttactgattgggctattgattttgatacgatgatgatggatatttgtagatcttgaattggaaaataaaattgattttgattgactccaatggagagaaccaaaaataaaattagcaaaaaaaaaaaacgaaaaggaaataattggaaaacttagggttaaaagaggtatttgaaagtaagcaagcgtgtgtaagaagaggtagaggaagtttctttttattttttcccttaattatttttattgtttttcttatgcgattgataaaataaattatttatttatatcaattcttttgttaaaaaatttgtatctgaaactcagacatagtttttataattataaaatagtattcctataagtaattatttgattatataatggaatttgtaaataaaatttaatatattattttaattttataattgaattctaagtcaatttcatttatataattttttacttactgctattaatttttaatattttaattataaattttatttaataaaattaaaatacttataaaaatatcttagcattatagtaagtgaaatcttaaagtgaaaaatagatcacatcggtagatttggattaaatattaagagaatgttctaaataatttatttatttatatataatttatttaaagtttatacagctattcaaatttatataattatataaaattctactctcctatttagtaagttagtgttaatttaattatttttaataaaagaattattttagtaagaataaaagtaaataaatagagaaagataataagtgaataacactaaaaagttttattctattaataataaaattaattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtctaatattcatttatctattcagtctctttttatttaaatatttgctccgattatttacaatttaatttttaatttaaaaatatctatttatatttttagtccataaataagtgagatataaaaaatataaaaagtaaatagtgattaaggcatgtcactgtttcaataatttaatttttaattaactaaaaatacaaactatctaaaaaatgtaattatattaataatatagattacatttttaaaaattttaaaaatgagtaaagaaaaaagtataaaaaatatttaaaaatatattttttatttttatttttagttttcagtaaatgattgtcacattaatgtcattttttgaaaaaatgctatttattttgcaaattcattggtgatatcttttataaataaagtgtattttacaaactcatttaatttgaaggtaaaaatattattgaaaccttaaaaaataaataattaaaaaaaattaataaaaaaatttattagtgaatatctatattcaatctaacccaacttatataaataaaagtcatttttttattatcttttactatttgtttaattcttacaaattatctatttaattcataatataataaatgctgattagaataagtaaaagagtaagggtgaaatttatcacctctaaatatagaagtataataatttaaaatttaaaatatcagaatttcttcattgttgcataatatattttttctaaacataaaatataatattttattaaatataatatcttattaattgcacatgattttattgattttatattttattaatttatttttaatataaaatataaataaatatttttattaaataaattcgtccaaaaaaagtttaaaattctttctataaaaaataaccgagaaagaattaaatgaatttaaagtttgagtaatttcttcgtataatgcatttttactccaaatgtgacttatagataaaaaaagttatttcaaaaagaataaaaatgaatatatacaaaaatattcatttatcaaaaaattaaccatagatttaattttgtcgataatcaaaccatataatagtttttttctttatctacatactttagattacattttctttttcaatagtgggctcgggttttctctatcttctccataattaggcttggtgttggcgtatgttctgggtctggcttcgaagaaaaagaaaagcggcggagaaaagaaaatgggaaagagagataagaaacagaggcatcataatcaacacagaagcagagtagcttcttactacaacacagaacaagaagatgatggttatagctattcacagtcttccttacctaatgaagactcagacgcagaacctgatgatgttgaagaagaagaagaagaagaagaagagaaagaggacactagtgatgcaaaagcatctaatgacgttccttcaaagtttcttctttaccaacaatctgtacaggtatttacccatgtatcgaaatattatgtgatcacgttgcttggttgctgagaaagattttatttttcctttttcttgtattcaatagtttgctagactagaaattgaggtagaaaaaaacgagcacccatctgccaatgttggttcttgtgctgctttggattgataaaaagatgtttggtcgtaatttagaaatcaagggctgagcttttgttgttaaaactgttttagttttctgtatctatagataaagtttgtatctttttttataataattgtaatgggtttagtggattcttaatgaattgcagtcgcccaaaggagatataagctatttgcaaaagttctttttactgtatgttggtgggaggttgcctcttcatttccaggaagatttctgcgggactgctcttttaaggtaaattactatctttctctcttttatctctctccctagtagaaggaatttagttgtttcagtcatggccactttatatttgcagctggtccaaatacctaaaacatgggatcccattttaatagattctttcaagcttctacctagttattcttaggaagcaaataattggtgaacacagaagggtagctgagacctgctgctttagtttgaggcttttaagtattgatgtaagagctgtctttaaggagccatggcttgcttagctaaagaacgattatatactaatacttatacatctatgtttatgacagtacagaatggctacgtagtgactcaagacggactgctgtaggagtggatttagaccttgaggcactaaattggtgcatggcgaacaatgtaaataaaattggggctgatggatattccagaatatccctctttcatggtaatgtcttgcaaccttctgatgctgaattagtcaggtttgagccccaagatctgataagtaacatcaaattgggagagcagggagacaattctgagaatactgcactggaatctgctctccaagtgggttcatcagcttctgttagtgataagtacttgaaaagaaactttcagttaccagcaagagacattgtgtgtgcctttaactacagctgctgttgtctccataaacgagcagatctggttttatatttcaaacatgttcttgatgccttgtccaaaaagggtggtttatttgtgatggatttatatggtggaacatcatcagaaggcaagctaaggcttcagagaagatttccaaattttacggtatagtatttctcttctcgataccatgacagattacagtcttagtgggaggttcacatgtacatatttggcatgcatcactttctttgctggcagtttcgcatttagaggacataaaaactctcaagcagcaaatctatgaaaacctatgctataacttctcttattaattgaagcagacagcagacatatgaatacaaaggtactttacatacatataactatgattttatggaaagcattttgcttgtctttttctttgttgttgtttttgaaaattcaatgcatgatttccacagctaatggttttcttataattatgcagtataaattggaaaagtcaaatgcctcctgtatctataaatgaatccccgatagttatatccgtaagcacagattttctgtcaaagttgatcttatttgctgcatgtatcatgaagttaaatggtcaataccctcggcttcgtgtctcctgtcgattgattttttcttttttaatcttttatgatttctgttcaatatgtgctttaggatatagtaggtgaattacagaaacaaactcacatggcataagttactatatacgaagaaaagaaattaaaaatattgtttgctcttgttgctgaattgcattaaatgtgattcaaaggtgcaaatatatctcgcatctttcctgacacggttctagtgcagaactaaatatatgcattgctgatgcacagacaattatgtcttcaaggtatagagttatttctttgctatttaacttttcataaaattcacagtatatctgggagcaagctgaatttaacataattgagcgcaaaacaaggatcagcctccactttcatcttcagaagcagcagaagaagcttcgccatgcattttcatacagctggaggctgtaagtcgtgtgctttcccaataaaatttctgcccagccagtttgaatattggcaacaccgaattttggtatgacaaactctgataatgagtgttgatctgtgcaggtggtcattgccagagatcagagactgcttagaagaggctggatttaaatccattcacttctggcttcggaggatgccagacagcaaagacaacaggagcgtagagggattcgggttcgggcgagacataaagtacgaggaggtcaaaacttttgaacaagaagattcttggaatgcatacattgtagctgttgcatagttcatctcctcagagttgaatctagttctcgctgcataaatttctactcttatcagaaaaacaggaattggaggatgaccaggtccttagctgttctctgccctttataacttgttcttagctgaaactgcatatgcaacttttcttagataatcggtttaaggtgtttatttattcttacagttattataaattctaatcaattgagatatcgacccccataaaaattaataccctaattttgtcctaatctatatatattatataatattatcttttgtttttaactatttcacaaaatgtctcaaagattaatgttagtagaaaaaaaatattaccatttctttaataaaaaaatctaagaaaggcgacgctctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagacagggtcaagatcaagtgagtgggggaccacacaaaaaatacattaataattgaccatcaaacaaattcatcaatcaatcgctttggtataatcagaaccgtatgttcatcggcattcttattttttaaataataatatatttttcttttcttctttcaaaaaaaaaaggtccaaaatggcgtgtattagaaacgtagcttaaacggcttccagaagatttctgatggaaaactcctaaaaactcgtttttatttatttcttaatacgcgtttaattacgtattaaaaagagaaaaagaaaagaaaagaagaaaaaaagtaaaagaaacagcgttttgtttggtagagaaggtgagtggaatcttcaggcaaagggaatttaattaaacaaagccaggaattccttctctccttctttatttctccatttctttcttttatgtgggattgctttccctgactccatttccctcatacttttcttcccaaggattcttttccctttcctttcctttcctttccccctcttttatatttctctctctcctcctcagcaacaagatcaaactctacaatcacaaagttgcaactagaaaaataaaatcatttcaggtaagcaaagaaagaaagaaaaaataaaactatatgctgttttttttttttaattctttttctctcatctaatcattttacgaatttggtgttttgtaggaattgatttttccgtagatttgaaatggcggaagagcacagatgccaagcacagcgtctctgcgtgaacaattgcggatttttcggtagtccggccacgcaaaacctttgttcaaaatgtcaccgtgatctccaactcaaagaacagcaatcttccaacgcaaaactcgccttcagccaaaccctaagcgcatcatcgtcgtcatcgtcgtcatcgtcgtcgtcgccgtcagcggcttctgtttctatttctatttcatctcctccgatcgttgacctaccggaggtcagcagcaaagctgaggtggtggtagaggataaggaggagacagcggcggagacggtggtgcggccgaataggtgcttgacgtgcaggaagcgcgtggggctcacggggttcaagtgcaggtgtgagatggtgttttgtgggacccataggtacccggagcaacacggctgtacttttgattttaaagctatgggcaaaaagcagattgctaaagccaatcctgttgtgaaggcagagaaattggagaagatatgagttccttttatttgaaaaaactaaacaagaaaatcaaaaagttggtttcttcgtgtgatttggaattttaggatttggcttatggaatgaaaaatctgatgaatgttcccggccgccactggccggcctcgccggggatggtggtggtggtggtgggttgttaatggatgttattgttgttgttgggttggtggtagttgggtggggtggggagtattattatgtggtgtatgtaaattcaatgataattttaattggctcttccttttttttctttttaacgtttttggatttcttgtggtggatgacgtggcagtgattatttatttatgcattgaaccgcctcttggccagaagacaccagcaaacatagctttggggaaatggaaaaaataaaagggttaaagaaaatagaatataaaatcgattaatggtaattttcaatcctaaaagatgttttaattaattaaagtttcagattgccaattattttctatgtgtcagtaatgtataaattaatatattaataaaaaaattataaaattatatatatttaaattttttattttaaaaataaatatatatatcaaaataaaaattttatttgttgaaatttaaatataaaaatgttttaaatttaaaaatgaatatatatatatatatattaatattataataaatatattattgttatacagtaaaatcaccataattatatatttataactaaaataaaatttataacaatcatatatttttagattaaataaaatttataattataaagatgtaatttaacggagttttaagtattaaaatttttatttgagctaaatgatataaatcataaatagaattatataaatattaatgcgatgaataacaaagttaggagttatcaaattttaattttatatattaaatatggataataaataaaaataattgaatcaaatataaatcaaaacctttaaatagtgtaatttttatttttataactccatacatagataaactgatcaacaagtaaaattataaagtatttttttttatatatttaccctttattcttataataaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataataaaagactttgagtcaattttcatatttaacacttcaattcatcaattatcaaaatcttactaaagttataagtcataaacatcattatttttcattttaaaaaagtaattaaattttaatttatttatgcattaaaaatataagtgtttttggttagtgttattaatttttactattatttctttaaaaagttcttattgaatctttttcttttcacaaaagattcaatgtaaacataacaattaattatgtgataataatatttttatattaataataaaatatatttttaatagttatttaataaattagtaatttaaaataaattataataaatcaaaaagaataatttattttatttatttattttttgcttttgggacgaggaaagtgatattaaacggatctaattcatgcgtgttgtcttacggacggatagttgcaataattctataaatgttgacattaacatataggctacggcactaaggcagttcattgatttaaaaaataaataaatcttgaatgttttattttattaatattagtttttaaaacatgctataaactgcttttgttaatttatttattttaataaaaaaaaagcttaatttatatagtttgggaaaaataaaacttaaatattattaaataaaacttaatccaaactacacttaactctctgctaactttcagaaattaatttacttaaaatttaatttaactaaaatgataataaaattataaattactccaaaacagagaccccaaattcatttttttttataaataataataaagtctatggttatgcctagagagaccctgaagagagccaaccaacaatattattgttgtaaaaaaagaaatacaaaatagagatttctgtttaatccaaaggtgtgactggtaaatgtaaaattggcaagaaaataatttcaggtatcaatattgcaaattgtagccctgttgctagtgggtattattgtgtggtgcatgcaagctcaattatagtttcaattggctcttattttccattaccttttattttattctttttggagttcctttaatattagattttaatgctatgtaatggtttggtgtggtggtgccaatttattatgcagcagatttcaagcataagataagctaaagtgggggtaggaaggaattgcattattgtttaataatttgagggataaaattaggatttgtaagaggtcaagttattgggttaatttgtattaattatttggttccacttcagcccatgaaaattagtctgaaacaacaagaaaaagaatattttttttttagaatttgcatttatataatgttttctctaaaatcaaaatataatattgcttaaatttgtagctcaagttccaaaaggaactagttccagttctaaacctgttctgggtcaatgattaaaattgccaaatccaataaagtgagattaccatgacaattagtaatcttaaataaaagcttttttaaaaaaaataaaaatccaataaatcacaaatcctgaagaacatggggtagagatttatatttaaaatatttttaaaattttactaagaaatattggatttcgctagaaagaagaaggaaagctgaaatgccaataaacgtttattattgaattcgattcatcgaacccgaaagtacttattttatttcaaaattatggaatgggtaaattgtaaattaataacccaagattctaaatttttattaaataaaatagagatccatcaggagaaaaaaaaactatagctgtagtattttaattgagttaacatacctttataaacaatatttttgctaatgttgtcttgaagcaattgcatgacattttatatattctattgggtagaagagtatctttcaaatattatatagtctttcattctaatatatatatatatatatatatatatatatatatatatattatttttattattattattataaccttttaaagaatcatatcttttctaggaactaaatatatattaattgatcggaatttgagatgacagaatttgctatcttcaattggagacttttagttttcttttttttagagtggtaggctatttatttatgtgtttaagaagaaaatccagatcatcaacaatttttaatgtttccaataaagattataatttgattaattatgggtgatgcatttttaaaaagttacaatttcagaaataataaaaataatgagaaaaactgttttctttgatacttgtacaaagttagataaaaagaaatggagggaatatttatttattccctcatctaactattttggaaatgtttggtttaaggctgagaatagaaatgggaatggagaggaatgaaaataattatattttatatattgtttgattgagtaagaaataaaaataagatttatttatggttagtactaataataatatttaattataattaaaaatgataatatttaatttttaattattgtaaataataaatataaaaataaaatttaaataaatgacaagttattatttcactcgtttggttatttatgattgatttgatttgatttttatggaaatagactttttaaaagggaataatcacatttcaattccgaaatgattttgataaaccaaacattaacaatgcgaatcacttattctcattctcatcctgtttttttttttaaccaaacgacctcttaatataaaaatttatgaaattaataggctattgcataacactattctaacaacaacaaagacaataacaataaagaaagtaatatattgtcaaaagaaagaaagaaatagataaaagaaaacaaacaatttcaatttgaaagaagctccaatgaatttgtagaagaagcaaatctttattaacttgttaacaaagttattaactttattcattagtgatgacaacattttattgtggaaaggcaggccttaactacaagtcaagaagttcaatttcatgttttaatttttgtttatgctgtctttttataaaggaagtgtttaacaaagttattaagctttatattaattagtgatagtaacatttctgtagaaaggcaggctttaactagaagtcaagaagtttaattaatattttttattttattctatgctgccatttttataaagtatatgatttaatttcttttggttgtaattccattattgctttttcaaaagtttatttgtatttcttaaaaataataaaattctgagaatttgcaagaaatcaaatcacaatcatttcttaaacatttataccttgttctaagtaatcaaatcacaatcatttctgagaatttgcaagaaattcactagttttggtaatttttaaatatttttaaagcgataaatatttaaagaaataaatattttttttattatatagtccataaattattaaaatttcaataaataaaaaatatatgggatactaatgtgttgttccaccttttgtttatacaaacaatacttatggaaaaaggattatttaatttcatgatcatgaaagattttagtgatctacaagggtttattttattagccttgaattaatgcataaggaacttgtgtttcttaatcatgaaaaaggttgtattaaagttgaattaacctatcccataagagaggcttttcttgattggtttcactagagaaaagaaaagaaaaaataaaatgaaagaatatgctgaagaaatgaattaaacaatggatatgggaaattaaatgattgtggattccaaagttgactcttccatgaaattgaattttaggcctatggaaattgtggtcttgtaccctaccacatatatggttattataaataagtattaaattgaaattcatttgttttatcactaatactttaccaaaaggtcttctcttgtaatagtcaccaattaccattaccaaacaaatcctcctgttaatttattgtctagtcaagtggcccatttatagaatacaaaatttaattcaaatgaaccaattactgtcatcaaaacagatttttgattcagggtaccatctctgctactagtccctatcttagcataattttactgttactaaccccttctggcacagcttttgcaagtgatttttttttttttgttgaaggtttttactttttttagcaattttaaaagtgatataaaggtacttaaatcagtaatttgtcctaattagctataatttacaaattttttaaaataaattatttattgcatccaaatctaaagggtaaattgatatttttgccctttttcttttccctctaatatcaaattaaactttatgataggatatgattaattgattattataatttaaaagttcacaaattatagttttcttttttgaaattagggttttgctagaatatcattaccattataagattttttttaattatatacaattaatcatgtattattttaaataatttatttattttatatgtcattattctattgatatagataaatttatatataactattaattatttatacaagtcaatattatatacgtgaatctcataattattaagtactactggttaaattttaaaaatatatataatattttaataaataaaaataatatatttaattgattaataactaatactatatataattaattatattaataaatttattagaattaaaataaatatcaattcttatagatttatacaataccatacacacacatatttaattgatgatttcgattaaatttttttcttataacacaaaaaaaatgttaagaaaatattatgtaatatcgtttcatattacatcaacaaaaattattgaacagaatggtctttccaattagttcttttagttataaaaattaaagagattttaagttataaatattgatgtaacttgatcaatttatagtaataatacaagacacttcacagcccattggatttttaataaataaaaagtaaatattaaaaatataaaattagaaaaaataaaataaataattttatttatgtgaattggataaattttaaaattgggatctctttatccataattcatacatatgattaaaagcttatcaccttgataatgtatatcatatataaagagataagtaatcatataacgtagagattaagaccctctaatatgataaattataatagtaattttcatctttaattctaaattaaatggttaaaattttattaaaaatttaaatttaaaatttaacaaacagataattatatgttgtaacatatatcaaccattgatttttgaattccatactcaaaattacacaaacatgacatctatcaggatgaagttgataagagagggtgttaatccataactcagagtggattcagctgaaaaataaatcccaaattccagggcaagtagctagaaatctggaaaatagacccacaaaggccaaaacaagaaatagaacaactgtaaaaaaaatgaacaatagcaggaagcagcatcttctgtatcaccagactttcaaacatatgcaataaaaattttataaaacacactttaaatgtttcctattgtcttttctttttaagccattgccaatctttttccagtactgctcatcactcacttagtccctctcttaaatcacccatctaaccttctttctcatttctctcccccaccatctccatcaccaccactgccacacacacaaaaaaacccttcctttcttctgagatcaccttcaccttttatctttccacttctttttattcttagtcatgaaatcttcatttctcaactatacctctcatcatcgaaatttcgttcccatttgcaattcctatttcactttcttgtagcatataacccacttctccattttcttttttcttgcattgcttttaccactacaagatttgggtattgccaaagactataccagtcattcagtgttttcttgtaattgttgaacatgtatatcctccacagactgacccatcattgcatttaaattaattatgtctgctagtacacactcttgaagaaagaagtttctattcttaactctcttgatgccaaaagtcattgaatttgaagatggatctgatacagatatctccaagatccgtacagtccatgttcaatggttgtggtggtgggcagatttagcaatacccatcaaccgggctactgatttcatttcaccaatgaaaaggtcagtccgtccattttttagcattctgttattgattgtgtttgctattactcttacttgccggatcttaatccggaaaggtgctttctttagctcaattgaacttgaagccaacgtaatagtccacccaccactcccagttttcaactctacattgcttaaatatgcagctattgatattggtgaagctaaatctaagcaagaaatagaacaattattagaaggtaatttttctagtcaagggagatataggacttttgctactcggagaaggttcaataatcatgatatcagagctagttcatccagaggtatacctgtaatatttaggtcccctcagttttataggtactggttagagtttaggagggtcttacaggattggtcaagaaccaagaggtatcaacctgatataatgaatgaattgatacagcttgtaaagattcccattgagagacgaaagggattgatgggttcaaacaagaagtacggttcttgtgctatagtgggaaatagtgggattttgttgcaaaaagattatggagagctgattgatagtcatgagatggtatttcgactgaacaatgcaaggactgagaggtttgagcaacatgttgggtctaaaactaatgtttcctttgtaaatagcaacatattgcatctttgtgccaggagggtaggatgtttttgtcatccatatggagctgatgttcccatggttatgtatatctgtcagcctgtgcatatgctggactatactatttgcaatacttcgcacaaggcgcctctcattgtcactgatccgcggttcgatgtgttgtgcacaagaattgtgaagtattactccttgaagcggtttgctgacgagacagagaagtcactggatgaatggagctctacgcatgatggttccatgtttcattactcttctggtttccaagctgtgatgctagcggtggggacttgtgacaaagttagcatcttcggctttgggaaatcagcacaggctaagcatcattaccatactaatcaaaagagtgagcttcggttgcatgattatgaagcggaatatgacttctatcatgatttggtgagcaatccacagttaataccattcatttcggacaggttcaagtttcctcctgtggtaatttaccaatgaactctgtctggttgtctctttttactgttcaaattggtggcagacatgaatctttgtgttgtaattgtaatcacttccacaagagagtaaaaaaagaaaaagaaagatttctgtttcatattcctatcctgtaccatccaaggtagtttaggatgattctaaatgtaaaattggcaacaatatgatttcaggatttgtctcctggcttgcttttgtagttttggatgctttaagttccagtgcatacacttgtgtatatggcaaatcatcctgcagcattcccaaatcacttgtatgtcgctctgaattattcatctgcttgttagtaatcaaaagaaacaaaagaaagtagaatgtaaccatgaatcgcaacgctttgcaaaatacaaaaatggcttatcaaattcagttttgctggtcttaattgaacataattccttctatggaatagctgagaatttggatttcactgtttccgtgtatggaccacagtttagtgtatgctgctatcgttttgaacaggaagtcggagtggatatgaactcaacatcattagtctttctcatttatagtttggcagggatacctgaattaagttttgtcaatttgtagaatatcattttatccagcattttgtttgcttctcgtgcctcctgaggttgattttccatcagtttgtaaagggtagtccccgctcccaatctagcaatttccaagtgtgtaaagtgttgtaaatctacaaaagagaggtataccaagaattcctggggattctgtttaagattggttttccgcactagtttttacccaagtttaaaccctctctggtgtggtccggtgatgtatgaatccctcaatgcaatgccatacatttcatgtaaagagtataaaacaggcagcatcagcctaattctaggccatattaggccgaattgcacactttcgatttgttacatgccggcttctattactacgcaggccacgccaggattgacttcctctttaacatgatttgtcttggttgttggacattctgccaagtaccacccctctttcacaatgaagcatttctccccaaatgatacttccatcatcttcagtgatgacattcaaagagaataaacgcaacacactgctgtaagtacttgccgactgtacttttatgggtaacgatcacatgcccagataccagacaccaacactgacatcagcccaaacatggcaggccgattttgcaacataaacataaagtcaaatgcaggacaaaaactatatacctataatattatcagttaaagcatagattagtgacgatcatatacaacaaaatccatcatcattatcctcacaaagattctaactaaacaacttgcgacaaacctattccctgtactcctattcctggagaatggcaaaagccaaaatacaaaagatccgttgtcatacagaaggcgttgagaccgcccttttgctttttctccaaactcacagctctgcgccctttttctttttctccaagctcacggctctgcagtgtccatcaccgcatccttctcctcatacttgattcccactaggaaccttatgcttgtctgcaatttcaacagatcatataagaagttggattctgaaaatgcactgctactttaaacaaaaccatccaagccaaaagaagttgcatcaatacctgttttggatcatagacggcgtactcattgtattccagggggccatctttattctctgatggcatcaagcggccgcaagggaccttgatatcatctctccacatgaagtgttctgattcatctgttttctttctccccaatcccttgactccaatcttcttctcctcgaaggatttcgtgtcctgaggagaaagtagctgaattatttttagggttcttaggttgttaaaaaataaaatgcagttcagacttgaaactaacaaacctctggggtgctcgagacctcagtgacttcatctccaagagaagcaacagccagaatcaagaatccttctggcctatctacagcagtaaaaccatacctagcagcttccgcagcagcatcagaacaaacaattgccttgccaaactgccaaacaagttcatcaggaactgtgacattagaaaactcaaaaaagtaaaaacggaaaatatagtagtatttcttttaccatataaccaggcacaggaagagaacaagcagctggcaagaaccctttttgcaaatgccttaacaagttcgagcttcgcgtacctggacattgaaggaatttagtgctacagccagagcaaataaagttattatgaaggataagatggacaaagcctcaaatctcaccacaccacaaaaggactttgtttggtaacttctttatctcatccaaagaaggatgagcacttgattcgacagcaaagatgttttcaactgatactccataatcctaaatcaccacaagcgcaaataacgtcacaaaatgtaaaacaacacagacgaacaaagattaagtggtcttacaatgtctccaactctgattggttcataggttctttccaggtaattcacaatcattttgtagtcgtcagtttctttgcccactggagaaattgagcatcctaatttcttgtaccggtctgataatgggtcatcaagagttgagcctgacatgtctcctataagacgtgaggctacatttatgtcgcgaacagtctcaaatgctgcagcaacctacaaattaaacccatgaacataagtgtcaatttaaaggatggtggcattgtctatataattctgataaaaggcagcttctgttgagtttacattatctgcaagttcatcatagtctcttaggatcaaaggccgagtagaatgcataagcgtaaaccatctttggctgtaatctgaccaaacagcctctgccttttgccctgtccctttcatggatttcactgcttctacaaactgaagtaggacctcctcacctgaaagtgctcgcttagttatttgcaaggctgaaggcaagagagtgacagagaaagtgagcaattcttacatctttttaagtgaagatccgagagcatccccattggcagttcaggagggtccaaacccatctccatcaaggcatacctgtattgaaccaggcctcagggtgcaatttgaaggaagcttgcagaacagaatatggttagtgccatacctataaatctcctgactgcacagaatcttcataaaatatgcaagctgcggctcaagtttagaatgagctgccgcagctcctagctgccttaaaccaagccctccttgtctcacctcaactccgtcatcctatcagaaagctcttatccataaggccatagcactcgaaactttaaaggcaagtgaaatatagtctgatgaaattgtaccatgtcgataggatagaattttaatctcttcttttcaaacttcttctctctttcccatggctcaaactcatttccagtaatttcctcaaagatcttaacaaactccttcacagcattatcaacatcttcccactcttcaagtctttcatcggcgccaggatcatcgccgactctccctttcttgtagtacaggtgcaggttactctctggcacattgatcagttgcaggatacaatagctgcaccaagtagacataatctgtaacttgaccaattcaggagaaagtctattgatcaaaataagcacaatgctaaagggttttcgcatgttactcatttatttctcgtcccatgtcgcaaagggagaaggcacagttgtacaatatcccatctttctcaaatatctctccatctcgttcctgcagtttactatccttatggacacccctttttccatatagtttgagctgcattcacagattcaattattgtgattaaagttttggcaggtgatgtttcttggaatgccttaaggacttgataaagttgataattaaatacttcagctgaaattgactcaagagcttcttcactagtttcttgtttatcccatggaattcctttaccctccacagcaagatcagagactacatcataagcttctagaggcagaggttcttgcttctcaatgctgtcaagcagccattcttctctagccacaggtatgttcctttcccttcaaggaatgtagaggttgattttgatcaaacaatgtacatattgaataataaaactttaagagattcctatgctcacattgcttcagagagcttggaagaaccgcctctttcgcgctcagccggtgaaacaacaaggcaagtcacacctatatatgtgttattgcaacagtaatagctagtgtaagacataaagcagaagaatctgaagcagttcagaagctagagaacaggacatggatttaagttttaccaataaccgaattggagacctttcccccatatttttcaatagtctttttccaatattgctgcattcatcaacgaaaattgctttatgtaatggcaatgtgatgcaaaatacacaaaaagatggttcctgctacgggctataatagtacatacatgagttcgcgaaagacggcctgacaaagaaataatcatccctgcaaagggcttgcctggtgcacctaactcttgacgaggccggtttttagggtcttgatgcttcttcagcaactaaagataccaaaaaacaaaataactcaataaaatgacttaagagattatgagacatgtaaacatcacagcaagaaagagttcagttacatctgcaatgggggacttgagaacagaatcagggaatttgagtggctcctcttttcttggtggacttcttgtcttgaaagtgcaactagaccactcactgtaaaacccgttgcaagaataccttttgccatcaaattccaaagtgcagtcacacaatggacatttcccaagtggcccaagcaacaataaatcttggctgttcaagaaaagacatccaaaaactatcacttaaaactataactagtcaagacacatgagatatatttgaattaacttggtatttatgattaaccatttggtgataacagccccatcagagccggaagaatcttgatcattcatctctagtatttctcgcatttgagaaacagagagatgctctcttattgctctagagaactcctcaaactctttagaaatgtcagtcttagttttctcattagcatgactggaatcattttcgttcttggccttctttggagactgttctccttcgtgtcccttgttctctgccttctgctttcttgtcattactttgccttcatcagccgctggtccatgtgtttgagaccttgtttcatggaccttctaattttccatgtaaaaactaatgatcagagaacatgcccaaacccaataaactagtaacagggaagagcttaaaacgtgcaaacgaattgacagaacattgaaaataacaagaaattaatcaaataattaaaaggaaatgaacaagaactaaccttcatctttctattagtttcttctcttcaaaaagcaaacaactgacaagcttattctcaaaccgaccaaatgaccgcttcttgtttcacttttaacattaccaatcttcttctggcaagaacaacctaataaagagacacgtaaaatgcttctcttgcaaagtccaaagctgccgtgtcgtctcagtactataacatgtgtactgaggtctgtacctagctgccatgtgtccgagtgggttcttttcaaaagcttgagttcctgacaagtggtagtaagctaattactaaccagtgttgtgtgtggttttactctctgcatgcaccaatattattttcttcttctttagtgtcattcttttgtatttgcaacttggcgtcatatcagcttcatgggcaacacctggttacgtaaacagctgcagagatatggactgtatattagtatctggtttgagctaactttccttcaaaagaattaagaaatggtgcgaatcccgtcaattaattggattatctgaagacagccgcttcctcgtattttgctttttccctataacttaattgctccaccataataattatggatgattcctccataatcgtgttctctcacactaattatcatatgttctatcaatttattcgtatacatattaatcaacagtaaaccacatgatatataattttgggagtgagttcgagtactctcctcaatactatatcaacttatatttttatagtacatctattactcctgttgtatattcataatctgtcgatcctttaataaataaaaaaataatctgtcgatcctttaataaataaaaaaattatatgatatataaaatgtgatagcctcgtttgaaaaagcggtccgacgagggcggaaagtgaacaccgagataaatacaggatgcctgtacaagaagaggcttctgacagacttttaggataacgacactctaaggtacgggagtaaatgaatgaatcgaattgcacatcgaaatgaggtagaaaatgattgataacatatatgtaaagagttggaactaattacaagaagcgtcttttggttgtttggctgtggagttgtaagaactctaaagttaaacgtgtttggttcagagaaattctaaaatgggagacctcctgagaagttctcgaaccctccaaagggataaaattgtgatggggccaaaacggacaatatctcatatgatctggttccaggtcgttacaaatggtatcagagcagaacctctctagtagatgtgtggttcgaagacgaactaggcggaagttggtgggcatgtgacagcctggcctagaaaaacagtccgacgaacatcggggcaaagataagatgcctggacaagaagcaacttctagcatccttccaggatggtagcactctaagatatggaagtacatgaatgaatcagattgcacattgaaatttggtagagaatgattgataatatatatgtaaagagttggaactaatcacaagaggtgctttttagttgtttcgctatggaattgtaggaacttcaaagtttaacgtgcttggttcagagaaattacaggatgtgggacctcttaggaagttatcgaactccaaaacggacaatatctcatgtaatctgattccggatctttacagaaagaaagtttaataatctaacttattatttaaagggaaaattcatctttggattcttatacttttttactttattttatccagtctcttaaaattattattaagtatttcctttaaaagtatacttataaacgtcattaaacataccaaaaaaatatttaattttaatttattcagtccttaaaaatttattttatttttagatggctctaaaattatttcttttaaattttttaaaattcttacataaacacgtgttaattttgaaagtttcttttcaagaaaaaaatttaagaataaacaataaaatagaaaataatgcgaatgaaacaaaaaaataaacgtaattgaaaatattgaagttgaaaaactaaaaagcaattactaatttactaaaaattattttttaaattaatctgtctataggtataatgtcatttttataagatatttgcaatttaaaatatcaccttctaaattgatatacaacttctttcaaaagatcatcatcgtattctttttggatgatgtatatcagtttaataaattattgaggttaatatttattaagaaaaattagcttataaaattaaaatatagtaacactattgattagatgttattagatttgaaatcccaaatttttcaggatgtattaagataatttttttttaaatctaaatttaacgaatcattcttactataaatttacaaaaattattttttatgttaaataaaataaacgaataaaataataaaaatgagacagaataagttcagaataatctttttatacaaattcaggatctttttagattaaatttaatgatatacggcgaatcaagatctaaataatgtttgaatataaaaaatataacaaaacattatataaacttttaggaacctaacgagctaatattaaaaggttcaaggattctttaaaataacaaaaaaatttagggactcaaatgaactaaatttgaaaattttattattttcttggcataatttactcacttgtattaatggtgtttgcaggcatgttcttagcaggaggattcaaaagttataaaaataaaaatacaagaacctattaaaacgcaatcttattgaggactaagtgaaataaaaaaaaaatagagactcagacatgaattttgccttttttttaatataaaaactgttaatatcttttatttttaaaataatcttgtaatttaatttttttttttaaaataaacttgttatttaagttaagacttagtttaaaatcttttagttaaattaagaattacttaaatcacttaatcaagatatctgatttaaaatttctatttaaaatatcaagttcaattttcttagtggggtggttttatactctattacatatttcaattatcattaataaatcaaaagtatgcatctaacattttacatcattaatacatctttaaattattatttacgttcatgtttttatttttatgtatttatgaagatttttattttcaattttgttgttctaatttctaatatatttcaaatttatttggcaactaaatctttgaaattaatattataatgttatatttattttatataaaattataggaagttttaataattataattatcaaacatattaataaaattcagcattgatcacttaatttttaattttaacgaggctaccatactaaattttttaaaaataaccatatatttatcatgaaaagaacttcaatgatattaaaaatatggttaattttcgcataatctcctaatcaattaatgtttgatctcataaattaaacatattaaataaattaaaaactgagttaatgctagtcctacaaatctaatttaatttactcaagtggaatagcatattcaagtggatcagcatatatctgtttagtaattggtaggcctaatttatcacttattgggactagcctatggtcattttccaaaatatttggagatggataatttgggagtttacaatatttggttactagatgtcctagtgataaattttcttgggttaattaattactgaaaacactgcccattttggcccatgctattttaaatagctatttcaatttacatatattttttaaaattctatcattctctcctctttttttaatctcattttttattatattttattaagattttatcttttaaatcaccatcgatcacttttaaattagtaatgacttttttaattttaataaaaatatatattaatatattttttaaaaattttatagtcctttattatacgtatttgaattctactttatagaatttttatgattctctattataaaagttttgaattttttatctgtgaaaatagtaaaaagatttaatccatattcaaataatgaaagtcatcaaagcttctataaagtaatatatagtttagtattacctaataaagtgttcttcttttagaattataatgttctgtcaatatgattgatgattattaaaaataaatttataaaatttaatattcacttttatcttaaaatgtacttaatttcttcttaaaaaaaactatcattgcatttttcctcaattttgtgttcatgcaccgtgcgaacatttttatgcccacttctcctaatgtacaagcgtgcgaacatttcatcatagaaaagaaaaagaaaatcacttttattaatatttcttttagaactccatttagtagataaagtttacaaataaacttcaaaaagattataaaatctatatttttgataataataaaagataaattgtaaattacaatcacaagaacttttttaagatttaattcgaacttaaaattaaactgttgaatttcaattctgctatttttatatgagatatattttatatgtacaataaataatttatatatattttttaattttaaattattaattggagattatttaattatatctttcccagaaaaagatgaaatgtaattgaaatagctatttatatattcaaaaaaaattactattaaaattgtaattccatttttccaatcaaattgcaccaagagagaactttccattgagctcaaaataggcaaaatataggattggcttgctaagccaaatagggaaaacgaaaaatattttaaaaataaataaaaataagaacccaatcacacgaattatggaaactaattaataaaggcaggaactttgatttcttaccataaatttatttatttatttattgtccatccgacaaatcatagtggcggtccctaatcttcaaaaaaatatcaaaacacttcctctctcatacacatatttttctcctcctttccactttttagttggtcaagtcctattgttaatatatgataagtctttatgtggctttgtttgaaaatacaaaaaacaaaaaaaaccttattcacacgtataaaacataattgatgttcattgcttgaatagtattattataagatggctaaattttgttatataaagttaattttgtataaggctttttggtataaaagatattagatattattattcgacattaaaaaaaatatcatcggaatttaatcgatctgattaattgatcagaaatattgaaatatttatatttttatataatatttaaaacgccataaaatttaaagccttttatactaatacttctttatatattaattattattagtataagagaaaacccttttatgggtttggattaatttcgagtacaagcactaagaagtcgggtgtaggactacaaaattcacttcttttttttttcagattaattaatgcttaatcattctccagttgatgttatatataaagataaagatatggtagaattgttggtagggatgattttgggtgagccctccattttggactcttgcttaacttgttcatcttgcctttgacaatagagacatcacatgtgtatatatatatatatatatagacacagagagagagagactgcagtttctagagtttttctttttcaattacgcgtttcacttgagtattttacattatggagtttaatttgccactgttttggcatcttaaatatctatgcctggtgctgtaaatggcactaagtattagctatctagctggtactttcataacttccaacctaacacctaaactatcttgcaactgaagccctggagacagggagtttttgcaagaattaccaagttcaaatagttatgcttacacttaaaagatggtgcaagcttaattaatattccgaatttgatttttgaatatataattgcataatttttgaaaattatacgttgtcacttgtaaatttcatattcgatatatcggagaattctttaaaaaaaaaaaaaaattgtctcaaattttgttttcttcctcatggccctcttaacccaacaaagcaaattaagtaagggataggatgtttttgtggatgcatccttttaggtaaaactttacttttattttacactttacacataataatacggatattgtaaatctaaaaggttacaacatcaaatcatgctttctaatttttcaagaacgtaagtatgtgatataattatagttcattacattaatatcattaattaaataaataaatttcacttcagttttttcatttatatatgagtattaaattagtcattagattcatataataaactatcatataccaattattattttgcaaataattcttttttttttcaaaggcatagaaatatagcactaatttcttagaactgatacatatatatatataattaagaacataaaagaaaaacaataacaataaagatcaatgtattgatcaagatcacctgaagtacttagcaatgaagcggacaaattttctcctgcatgatgcataaagaaagcttgaacataatacatgcacttatagcaacgctacttataattaatctgtggtcgctaaagaagaagaaagaagaagaaggagaaaattcatcaacttcaccaccaacttcaggtaatctatctttatttttggatgacgcatcgtccacgggtcgatccttaacttaattactgcgaaaaccggaaaaacaaagtaattttctgctcacaacatatcctctagcaagcaatgtgctccgtagcaaaccgctccctctattgcttctcatgctgtttgagaattttttgttactgagcacaagcttttcaggcaaattatgagcagcagatatatgatagctttccaactccataaacaagcgaaagattgcaatgcgaggcgaaaacaagaggatattcgtgttgctagctagctagcgaacgaaatcatcttcttcagagccagtagtaatgcattccttctgatcatcttcaaaaccttcaagagaaggatgcggagaatggcctttgccaaatgacctaatgtgatctttgagtgatcttttgtgcttaaaatcagaaccacaagtacaataccataacttgccacagttcttttcatgggttcgccaatctcctttaactgcaaaggttttcccgcattttctgcacataaatggcttagcaccgtgctttcttttgtagtgtgtttgaagtgttctgaaatctttcaatggctttgctcttggatgattgatgttgttcttgcatccttgcgcgcagcagtaacatggtagccttaacattgctgctggttgtgttcctctgagtgagtctggtccccttctgaattctgatccatgcccccacatatgcatctgcatacacaagccatatatagaaattttctgtttagttaattagtctccaaaaggactttaaactaccattggtctaaaaactagcagagatatgctaaaattaaggtgttaattttggatatatatgacacctacatttgatcctccaagcttataatcattggggagttatatagttcagaaataagaatccaaagtaaagaaaatccactctcctactttttcttttgtttgtttttaatccatggagggccttgtttctgttttttgtatatcttttgatagtgttttgcaagttacttgtatagtttataatgccttctttaatcattatcagcttctttatcacatattctttttacatctgttgacaatcttgggacaacttttatctcttcaatcatttttcaactaattaattatcacctccttttactaatattgtgagatttccacttactcccaccccccaacttgctttcttcccttagcttccacactgaagggtgagcaaggatggaatggaagagacctcattagcattagcttagggaaggaaatttcattaccgacaaaaagaaaacaagatcaattaaaacaaactaaccctaaagttgttaaaaaagaattgtatttattttaaaactttgctataacaaatgatgggttttaaataaaatatagatgaagtataaattcttttaattaaattctacaaagtttaattataagcaattgcacaaaaacaaaaataagtggaaagaaaaacataaaagaaagaaaccatttgttattcttgtgttaatcaattacttgcatatgaaacttgaccattacttagtggatatataactatatataatgctagcaagattagaatacaaatttggtatgttattttgcctcacattatttgagatcatatcgataaaacaaagagaaaaagcggattgaaaatcttttcttttgaaattcatgtggtttcttacaatcaaaagaccataaaatatactgaaagaaaagaagtcatgttaaattagcataattagttgttcaggtttattataatttatacatttttaattttaattagttattatggctctcttctctttcttttttttttttttgtgtgaatggtaattattaactgtgatcattgattatatatataggatcaactttatcatttccttttaccatggatgcattgtgttatctacttgtccccacagaaaaagaatacaattttgaatgctttgcctaagtttttctttttcttttttttttttttcttgcaaagatagatattatgtatgtatatacagagacagataacatgcctatacgcaataaccttagaattgtctgatcatataagatcaagaacctaagcaatatgaactatacacaccaactataatatagatatctttgtcctgttaaagaaacaaacacaaagttaaaaagaaagaaaaaagatttggatctcaaactaattgaggccaaaagaaaaaagataaaagttatgcatagcaattatttgtagtcattcttgatgttattagaattccatacgtacctaaaatatcctttcaaatatatccaaaagagaattgatttgtggagatgaagacaagaaaaggaaaatactaataattatatatgtagactgtagaggggattgagttgagctaacctgcatgttattgtacctattgaaggtcttgctgcatatggagcactcaaattgcataggcccaacaaggatctgagcaggagttgggatccaaaacctactctctgcgttaaaggtacagccatggaagcttttcttgatcatgaatggttgttcttgttcttgtttttcttgagaaactttagtctcaacttgatcaagatcagaatctccactactggtattgggtagtccaatgtgcaaagcaactgtaacctggtcaatcttttcttctttaaccacactttcttgcacttccatattctcctcctccttcaattcttccttctctgtaaaaagaggcaagcattggatggtttctttaacaaactgatcttgattttctagctgttgagggtacagaagaggaagttttagtatggtcatggatggatttgtgagctgaacttgttgagtagcagaagaacatgaggatgacgatgatgaagaagtaactgaagaagaagatggcttgagccattcaatgaaagtaggaggttgaaagcatagattagtattgtcttgaacatggtaattccataagcccatgtttttttttgttaaatgagaatgaatctcttgaattgcttctctctttctctctctctcctttgagatggcttatatctagagtttatgtgggaaagctttgcactacttaatatggtttgagaggttgttttggtttgtctttaaggaagtcttttactcctttcttttcaacactttagagagagaaagagagattagtggtggggttagagaaaatgacatgcaaaagaattgaactcaataaatgaagagaatcctagaatagtttttggactattttttttaatactatatatatatttgtatgtaataatggttgttattttttagaaataatttatctaattttctgtatgataagttatacttttcaaaaattattagatcatagtataaatgttatagtgataaaattatgggttgtttgtcaagaattagaaactaaggtaaattgtataaaccttttagagacaattaacatcacttctcttacattttcttgagacaagtaacagtacttctcttatgataattcgtttacaaatatttgatttataatttggagcagagaagatcatggaactcgacccattttaatattttggtcataaaatcacatattgagagtaaatgacctcagaaagaaagaaaatgcagggagagatggcatttggtcaatacctaaaagtaaaagaaaattatataaaaaaagaaacaaccctaatcatatacatacatgggatattagtaaatgcttattttatgcttagtgcagtttaacttaacctaagcaatgttggttagtgttaaaatttcaatttaacctgcgagaagctaaagtattttattagtttgataaaaaaaaaattcctagtattttataatctagaataagtttgacatgtaaaaacgcatataaattgatgggtaattaccacaattttaaaatttatatttttagtcatgtactcttttaactctgttaaggtatgattgttgatgcaatcttttaataattaaatatataaatatatatatggttcttttcactttttccttgcggtacttgtacgctatcggtgaacgaggaatacttaggcttagagggtgattccctttctggcataaaagcgatcaaaatttgaatacgtccaacctcactgatatgataatcgatcatttcttcctattcaatttatatatatatatatatatatatatatatatatatatatatatatatatatagcggtgcttcaagttagtaatatgataagatcacttctaaaatggggttacaaggatttataccaaaaaaatacctataaggatattcaaatatttagaattaatttagttggtgccttctcttaaaatattctaaaaatttgacgaattttcaatcatgtattaaattttccaacagaattcatcaggatgacaaaaattgttacttctttcaaatcatcgatcttttagtgtcagcatattgtaccaaaaataaatgtagtaaatatatcaaacatattccagagacagaagtatagtcagagattattaatggaatttcaatataggctgcaggagtacgatatatttgtactgctagccacaaaatatttataaaattttgactcagatataaaacttaagtttaaaaattgaaaatgggtctaggcttggattttgtgtatttttagttatgacttttaattaagaaaataaacaattaagcatagcatactatttaattaatttcgattgttttctctattaattgggccactctatatattattgaattaacatattttttcaaaaaaaaatttgttatcattttctaaaatttctattagtttcaagaatgcaaagcaatgaattaaatgtataatcataagcttcaataaacgaaataaaattgcatgtggtggtgatcgagtagataaatgatggagtcctgtaagaataacactctacctcattgccaataaggcgcgttgaaagataaggcatgtgaaaactagctgcacccactatttacactaattcttttgtgcaaaatgtgctgcagcttgaatatatattgacagaccatataacagaaaattgagaactgacaacatctcctttaaaccctatattcctctaacggactaaattgacccgattaatttatttgtatgataattatagatgagctcataaatttagagtagattttaattagtttaatatctttttgtattagaaattgaaaaaatacatgagttgaatgtgctttctcggtattttagtattatggttaaactgaacaaatatcatagtgcacggatgcctcatgctcaagattatggattctaatttagaagattaccagtggatacaagttcctgacatcgtcgatttctaaagttttcaaggggcggagacgattaatctcatccatgtgaaaagaaaaatctgatcgaacaaaagtaaataaagacccacaagagtgtgaatgaaagtttatgcctcaaatctttgggcaaacatgtagagaagaagaccctacaaatgccaaaaatcatgcaaaactcattgtggatatatataaactgagttttggatataagcttaggtttgaaaaatcttgaaagaaaaatagccgacaagagtgnnnnnnnnnnnnnnnnnnnnnnnnnnnnnnctttattgtatcttatgtgcactgtctatgattctctctacctcctccttctcctttcatttttttccctctgatatccaacatgtttcctttactcttttcttccccccattcatccattaatcatacattgccaaaaatctttcacttggacactttattttgtttttctatatgggtatgcaaatatctttaaaagggcaggatgcttgggatctgaatttacaattcccttcattagatcttaattacatggtattctataagactactgattaatacttaattttttgggatttatgtaatcaagcattacatgcattactttttggttttagatgaataaaaacaaatgatcccaagtgaaatcttttaaagttaattaagagtattgtaaatatatgtcaattagacttcagtagctaattcttggatctacacagtgcatatgtgttagatcacagatataataggagagcttaattaggtagtgtggcaataatttagacaaaagtataaaaatcaactttgtaccttcttgctccttgcatataatttagtccatcatgtctttattggataacaaattcaaattctgtgggtctttggtttgagattttaatctcgtttcttttgtcccttttgatgttttttcactcagattttttcatccacatattgatttagatgatagtttatacaataggtgtgggtcatcctcgatttgttggttttttcctcttatgatcccttttattatttgataaaattttaatcatgttttctaataaaaaaatgtgtgatacaccgtatacaacacgaataaatctatataaatatttatataaattaatcgcatgaaaggaaaatagatatttaatttattaggatataatttaaaattaattaaattatttttcacataagttttttttttttttttttataaaagagaagaacttttatgaaataatcaccctttcaaaatatggaaatatatttcaattctatctgacctataggagatttcaaaaatgaaataaaaaaataatataatccaaagtatcacctatatatgcaattatgcctatctaaattaggtttttaaacattataatgaaaatgtcaatcttatataaaagttatcacctaaacccacaaagaaagtttcccaattaattataaattctataatctcatcttttttgtgacctcttaaagcctttctttcttttatgttttctcaaacatttttccaccaaaaggtcatcatttgggctatggtgtgtgtatcttttggcaacagtaattaactaattaccctcatgaaattaagctaatttgtgtaaaaatataatataaaaagtatattgatccttctgatttttgggttaggtgtcctaccatcataattaatttttgtgattctgactttattaaaacagaaccctttgtctaggatttctttctcttgctgtcaaagaaatctggcatgataataaaaatgtagacctcttctttttaggggaaaagtaattttaagttgctcataagatgattatttcctatcacatttcatagatattataataataataaggcgatggagttaaaaaaaaaaatttgatttgaaaataagaacatttattataaaatagtcgattttagaccaatcaacagatagtcgttattttttttttttacttaaattctgaaaaagaggtatatgtctgtaaaaaattgcctaatggtttaaatttaattaaattctgtgcttatatatatatatatatatatatatatatatatatatatttatatagctttaagatatctgtaattaattaaagcacaagaaattaccagggaaatctttagcactcctttaatagtggcaaagccaggaagctaaactgagaggggcaaaaatattactatttatattgctttgaagtaataattaaaaatcaagaagagtaatgcatatttgtagaggaatgaaattaaaattgaaagtttttatgatataaaatatttaatatttctaaaatccccctttgtcttctgagtggcttcgccattttcttctaaagtttttcggttcaataaaaatcaaaataaaatttaagaattgaaacttattaaattttgtttaggattataattgttttcataagtctctttcaattgtttttgttgaatttcaaaaatatttttaaagaagtaaatnnnnnnnnnnnnnnnnnnnnnnnnnnnnnnnnnnnnnnnnnnngaagtaaattataaaatgatatcttttttaaaaaattgataaaaacagtttataaaagaaatttaaagtaatcaaatagattaaattaaaatattcaaaataattccgcataaatattataatcgaaaatacatatttcattttttttatgtattatcggctctgtaattcgtccgtacattttaatttatttttaataagaaatacacattacacattatagtatataaatcgatcgggaaaagaaaagaatacgaatgatgtgagataattaagaaagagttgaataaactttatgtcattggtttctgatatagagaatgaatggagcttttccatgtttccttttgtcttccaaaacgtgtattgtcacctccaaagctaattatgtcaagtttggaattatacgagggaccgtgatcataagatgggtacacaaccatttttgcatctggctcaagttttggaaaatatcaaacttggaggatgatgctcttctatgctattacttgactttgacttggtatttcctttcatgttcaactcacatatcattgcttcattcgacggccttttccctattttattgtaatatatatacacggcttgcataggtgagcaatgccacatcgagtgacatgtattttgactattcttttcatttagattttagaatgatattacttatacccagaaaatgatgctaatgatatgggaaagaaacgtgtgttaacaagaaatgaagggaaataaaaaagaagagtgcataatttgaggtgaaaataatgttatgagttaaagttagaggatgtttggtgcaaagatttgatgcagctcatagtaacaactatattcaagtgtttggtaaaaattaagaaacaacagttgatagttgatttagtccagtcagctgttgattgtatcggctctatttttaatttttttttattagctgatagctgatttgatattttttatttatttatacactattattcttattaaataataataaacttatataactaaatttttatattttataataaataattattgttttgaaattattcttaataattaaataattataatatgtataattatggtatttgaaatttaaaaaaaaatattagtagaatttaaatttaaatttctatttttaaaataaattttataaatatttttaataataaatataattaaactaaaaaaaataactataatatttttaactatcaaatatatattatataataaattatatttaatgataaattatatcatcaatagttatttaacatgctaacagtaaccgtaaataaaatcttaccaaacagtttaatttatcaaccaccgactatcaactgaactaaacagatcattgttatttcttaattgtaaagactaagtatattatggctagtctatcggcttggataatttagttcacaatattatggatttttttattttcaattaataattaataaagtttccattataaaaaaaacaaacaaaaaaactcagcaagtccctaattggggtttttatggccaaaagtatcaccaatttctcatttctgggaaagtcttagtgtcaaacaaccaacttagactcatattaaaaaggaaaaagttaatcattgcaattacatttctaatgctcaaatttctgtgcagatcaaattccaaaacttgttatgtgaggacttacccatatatgctggacttatgtgggttggtttctttgaagtttttgggtttgttgaaaattgaatttgagctaattatcaaatttctagacctcatttcttatgacatgggggtgtttaatttgattagagattattttttgactaaaataattatgaaatatacacattaggcattatgttttataattcttaaattaaattacgatttgaatttataactatcaatgtataattatttcaaaatgtgttgattaagttaaatccaatatcttatatatatatatatataaaagattagatattacatctaattatatgtaaacttcaccatgtaaaaacttttgtagaacataatttaaaataccttaaacatttattaattccatgaaaccaaaatgttaaaattgtggtttttatgcatcttaagaagtttatttttattttttttctttctaaagaaaaaaaatagtttaacttacatgagtcttaattatttgaaaaatatttggatatactattttcacttaaaaaatttaaaagaaaaagaaaaatgagttgtgtgattcacattgatgtaatggtgacatcaaaatcttacacaaaaatgttagcttaattttgtctcaaaagccatgagtatacactaaccatatatgtcaatttgtcataagacattgtggcacatatgcttcagaaagcacatcaatttggtttggtcaagccagtagaatttgaaccccaaaaatcatagatattgaaattttagctacccaagttgacttcattcaagtctctctctttttcttaatttctccaaatcaattttgcagtttaaaagggttttaaaagacttgatgatgagttaacagtagtttctaaaatggaagaataccaaccaaactagcaaatgtaaattcaacctggagaatttgacagttgaaaaagtttaagtgtctctctattatcttgacctaactatttattctttgacatccttcaatacctcatttgctctgctggcttaatgttaagctagtttcagaaaaaaaagaaaaaaaatattattttcttataaatatttggtgcatccaacaaaaactggttaaaggataatatttttttggtcaaatggagttaattcctcattctaaaaatggaaagtcatttcccaaatttttgaaaataagaatatttatatagaaattaatcaaatatattttagctaataaaatattaactgataacactgacaccggttagagggtgatcgatcgctgaaaaagataattcaattttattattttggagtaattttatttaaaataattaattataaattaaaaatataagactttaatgagtttcaaacattttaatagtctttttaatggaagagaaagtaagcaaacgctaaaccatttttaacactaatatatgggatgccatatcttcattttgggtgcacaatttaaaatagtcttaataatttttgtgagaacctaatcaaatttccaatggttttatgttaataaaaataaaattaaattaaagtttaagaacaatggtagaaattgtgtctcgaaatctgaggaccctcactgaaaattacaaaagctacaatacatatctcataatgtgatctgcttcacaaagaaagaaaattgtaaattgttccttaattatatagcatgttgaataatagaatttttgagtcggaaattagaaactaaataccattaccgtttctaattttcaatttgtaatataaaactgtttttaactttaattacgatatcacacaaatcttttatatcatttcttaatttaaaaaaaaaaggaatcggaattataatttttcgaaaagaataaatttataatttcataaagttcatatcaaattattaaatacaaataaaatcaaaaaaattacattgatcgctcttcagcaaactgccactctcaaattatattttttttaatttatatttttatctattttatatgaaaaatatgagaactaaatgatttttaattttgaacgaaaaccttccataaagaatattagaaagaaaacatttatgttggtaagaaaaaaaaaaaaacaaaaagaaacctgagtttgagaaagaaccaatgtatttgttaatgcccaattccccattcattgatgggctatttcttagcccgacctaaaaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaagatgagtccacgttcaaacaatcgaccttgtcaaaagacgtttaagagttaatacatggcttagtgccacaaagtgaaacgtatttcctacagaattataatttactgttttattataaatatatattttttatatatatcttttattatttgatatttatttttatttcttatgtcaacatcgataaaatattcatatgttttcttaaaaaaatcacacgatgagaaagaattaaaaaaattggaaaagcagtatcatcacaagaaataagtaaagaaagagaaaaaggaaaatatgacattgctgtggcaatggcactttcaattgctttcatgataatctttagatttacctgagactatttttggactctgaaaacaaacaaaaggcatttctcatcacaagtcccaccaccttttgtaggcattattttgttggtttaattgcccttcaatataattccatttccctttcaactaaaactgtcttcacccatatcaatcaattttggacaacaatgcaattgattatcataactgtaacattaaagattttaatttgaatcattaataaataataaaaaaataaataatacagccagccattaattatacaataagttggaataaatataaaaaagttctatgtagtttcactgttttataatttttaatatgtaaattttttatttttaaataaaaaaagtacatagttccaagttgtaatagaaaaatgtatatcactattaaaagatttcgattttgtaagaatttagccactttcacttcgatcagtcatcattgtcatattgtatatatttaataacgtgagtttgaagtttaataagtcctaattctattatttgaccattatatcatggtttaaaaagtcattggttcaatgagatcgttttaatggtcaaataatgatgttttgaattattaagttctaaacctatattatcaaacatgataaatatgataataataatttatcagaataaatatggctaaatccttaccaatcgatatcttttaacagtgaaatctttctttttgtcgtaatttttaatcaaatatcttttttttatttgaaaagataccacttactgaaagttggtaatttgtacttatcccttataagtttcatgaactaataattttaagacagcataattatgcaaaataacaaaacaatgaaaaatttcaagatcttttcataaataacgtatttattttatgtatttgaaaaataaaaaagttaaaataattcttattataacataggcaatatataaagagcaaattactaaaactctcataaattttaatagatttcctcttatttcaaaataaactgaaatttaattcccttcttattttcactacattttaatccatattagaaaataacgtataatttttatctttaatttttatgatattcacattcttaaattggaaaataataaatttttattataaatgagagactaaaatattattttatttgaaacttaatcttacattaaaaaagagagattaagatacatcaaatgagaaataaaatataaattcttaaaagtaaaaggcgatttcagataaggattttgaaacaaaaggatgtaaatataaacttttccaatgtaaggtagtttttagtaatttgcacctacactattggtccaataattgatataacgataatgcattagttaaaaaaaaaaaaaaaaaaaggtgacgcgccaaataattctctgaaacaaacaaaactgacgatactattactatagccattaccgccggtctgccactgtcgagcaaatggaagcagcagtcattaccaaaactaccaccgtcttcagattacctccatctccgttatgcttcgccgcactccgccaccgcaactcctcattttcctcgtccactaaaacctctctattatttccccgttttaaagcatctcatcagttgattactcgctgtgctgttgaaagacccgatacggttcgattgttcaaaacctacatctaaccttagtttagataaaggaatgttaaattaatttgttgtgtttaaaattacagggaagttatgatggagccggtgaaagctatgatgctgcttctgctataaatttaacaaatggatccaattttcttcagtcattgtttgattttacatcatctaactttcttcctataggtaattaattaattagtcatttttcacttaacaatttaaagttaaacttgtgtttaattatagtttttctttttggcagctttaataagtgcagtagctttaggaatggctagtccaactcttggttgttatgcgcataagtattctttatcaaagttcactactttcggtattttctttatttcaggtgagatttttgtttcggatacttttttctttttttcctgaaagctttttctttaatgtcttttaattttcatgcaggattaaagttgaaaggtaaagaaattggtgaagttgcagaagcatggcctgtagctatatttggtctagtatgattgacctcaatatcttttttcctcttttatgtgcctagtctatttcattattagtttgaaactttatccaatttgtgcttgtagtattaaggttgtagctatttaggcttttcgtgttctgcattttccgctatttgggtgcatccaagaaaatggttggtctggtatttgacatatgcatctaggagaatgagaataaattgctaattgccttttatgttgatactgttgacggttttctactgtatgcatacttggttattttgctggtctttctctatgaagttaggaaatatagtgtgttttccaataatctggagagggaggctcatttctatgtcatttacattagataggtggtttttgaatatagctgataggttctttagttgagctcaaattaggagcatcgctgcttcattatttatatcttttactctgtccttatttttatttgttctaaatcctaactagttttatttgtttattataccaggcttctatcttgttgtttactcctttcttctcctatctaatattgcaagttcgacttgcacctcaagagtttgtaacaggtattctaaatcctgaccgtgaaccagtatttgcaggataaaatcataatttgcttagtactgttagtacagcaattgtttgggtaattggggttttgaacaggattggctattttttgttgtgtgccaacaacattaaccagtggagttgcattgacacaagtatgcagtatcttttttactccctactatcttaattcccttttgtcgttttaaattaatctcctgtgatacttaaattatataactgtatactttcaatgatggcatttgcaaatttaattgaagcttgttggtgggaatactgcccttgctctagcaatgacggtgatttctaatctactaggagttctaacggtaagtctaaacttggtcttatgatgccagtgatttttaagtctgctgacttatgtcatattttgtttctgattggaaattattttttacaacttctcacagcttccttccttagcatgtgcaccttgtaattgttgaattagatatgcacactgtgccatcttatgcatttctcagttttgtattttccaaatactcaatggtgtgataatgttggtttgatcttgtaggtgcccttttgggtctcaaagtttttagctgatggttttggtgtatccatcccaactaaaaacctattttggagtctcatattcacacttcttgttcctttagttcttggaaaggttctttccttgcctttgtttttatgctccctccttttgttgttcaatatgactattttatgattagcttcacatgctgaattatttacgatcatgaggcattcttgaaagcagaatacagatgaaacatgcatatgactgtttattttttgtttcaatttttttccttaccttggaatacgatgctgttgtaaaagctttggcagataatagctggatgtttccatttcatcattgttattctgtcttgtcttctcacagtttgcgggattttgatgtgctttttcattcacaggtagtccggaatagcttcaaaggtgatgcttttcactaattcatttttgctttctgttcggtaatttttttttattacatctgataaatatgaagttcatatttaactcatgaacattaaccattttcccaacttgtcattgaggaacataaggtgcatctagaattaaaggaacataagctgcatctgctgcagacagctacctaaataattttcatgttcctttatatgaaagtttttcagaagatttgcaaggttggatattcttcctgatgtggcatgaaactaactaatgttaacatacatacattcattggtttaaggaaaaaaaaaaacagaatggttcttacttttatgtttttatatgtgcttttctcccataatatattatcaaaattattctacaggtttggcaacatacattgatgaaaattctaggactttctcagtaatcaatacctttctccttagccttgtaagcactgatcctccaaggcttcttgactattctaagatttcaaaggaaaatgaattagcttttgattttgttcttttctttcctttgttctttttgggctaattcaaataaataatttatttttccctgttcatattttttgttaagatcagttagtaatacctcaagcctagaccctagtagtttttagtctggcaattgaagatcctgcttgtagaaaagtatgaattaaatatgtataggacagcttgcaggactgagatttagattggaatgccatctacattgtatttggttgaaatctatgaaattaatagaattcatctgtaaatctaaagtttatgtgctttgattgaagtgaaagttaatttagaattctacataatcaaatttgtgtgaaattggttatagctaaactaaattgtaataaaataggtagaatttctaaaggaattccagattagtaagtcaattatctatttcaactttatcatttctattttactttctctctcatgtctttttctcaaatgaaatgaattcgttaatgaatttcaaccaaacataacactagagaaatagattctattaggaaaattaccaatgtaaattctggttcagtatggagttgaaacattccaggatcgacacttagaaatcccttggtcaccacatggtccacatccatggtttcctttttcatcacacatatagttgattgcattatgttattctgcaaaattgctggaaatttattcaagcaaatacttattaaccaggcattacaagcatggcatctctttctttgttaattattgaggttattcattaattatctgtcttggaatttgtgtggttatgactaatctatcttttctattgctatgtcatctatacttattgtttcttttgtagaccccatggatgcaagttagtaaatctagatcattgcttctattggttaagccgcaggtgtttactgaagctatcgcgatgggaatgtaagttctccatttaccaccacctatcatttctgtgttatgtgatagtgcaattctctacgtttatgcttgtagtacttgaacatggactaaaacaacttttcacatgcaactgatatgactattttcagaaagatgttttatttggaattttagagatagccttttacattgtaatctggagaagggaaagtaaggcagttgcaatattgaaattgatgagatggatgtctgttattagtgtccataaaaaaaaaaaaaaatctaactgtttaaacaatcttctggtttctggaaatggccaaagaataacaaaagatgtaagaattaaaaaaatgcacatacagataaaatcttgaagttacaaaaattgggtgcatatatacagggacgagacttatacaaggccaaaatcatatattgaggagacatgctattgtctttgaaagaagaagacttttgcaacgacaatgtcgtctcagaggagatgtaaattggacttcctgttaatttatattattgcattacccttctcctatgcatacactctaagagcaccatatcatggcgcagaatactaatgccatttgctgatttacatgctgtgctcttttctttattgtgcattgtttgccaaatgttgcttatgcagacagaacggaaaaatttagtattgtctttccattgccaaacgatgaattctcttaattataaaagattgctgtgtacttctgctttcagacttgtgcatctcgttttactgggatttaacatcattttggtgaaagccttatcagctggatttggcggtagagagtcagttcttgcaaagagaaagaatgcccgagctctcttgattgtctgtagtcaggttagtctcttgcnnngcttccaagcatctaacaccaagaattttagcaagcactagatatcctgcttacctctctactttcctggccggcctctaaatttatacacaaattgactatggtccttttgctatatatatgttcgggtcccattactgtttcaattggttttcgtaatatgtaatggcatgtcttctattctatataattacacgatacaagaagaaaatccaaagtggttgaaagagtaaaagaaaacgcaaaattgaggaattggacatcagcactcggttcatttgtgttgactactgcacatgaggtcttactttctataattttcctggtttgcagaaagcattgcttactgttatagttgtagtggaacagctcagtggtgcacttggtcaatctgggctattaattcttccttgcgttgcagcgcatattaaccaggtttctcttgttttctcttcattccaattcttaatttcttctttcttggtttttgtttcttagtttttcacaggaacagcataagcttacagtatatcattggtgtagatcgtggtcgactcatttctagtaaacttttgggttcaaaaggataagtcacacaaccaaattaaggaattctgaggcttgctgtcattagttgagaagcatctctctactgaaaagggcgcagttatatattcttcagagttcctatacatatatatatgtatgttactggaatgaagaattgtacaaatgtaacaattcattagcctattcctttgtctcttaattgatcgattttgctggctatgatggccatttgatctttacaagccatgttctgttaattattgataatgataaagagattactttcaattttgctatgagaaaattcagaaaattccagatgcaatcttgtttggaaaattgagaaactctcttagtctcatgcaaccctattactcctaccttcagtacggaagaggtagttgtgtcaaagcaacatggcacaggagagcttttgctcaactcaacaaaactataatatcgtaggttttaagtctaactaaagtttctagtttgagctttggatatgtagttgtgttaaaactcttgaggtaggtgttataatatcgtaggttttaagtctaactaaagtttctagtttgagctttggatatgtagttgtgttaaaactcttgaggtaggtgttttaccacccgcaagagtcctaccttgcacgttctagattactctagattattaaataaataaatactatagatggattaaatagagatgatgggatggagagactgaattagcataattttgtgggttgtcttgttactattggatcctcatattcacaacatgaaactactatcaaaaaactattacataagccacgaaaactgataatggggttggtggcttcctttctggcaagttgcaaagttgttatattagagctacttattatcacctaacatgactattaagccaacagattccaatgaaaggattcctcgaatgcacattatcaataaagaaattgaaatttcatcatcagaaaagtaaagttatgaagaatggaagattcttattttctctttgagaaagctaccgatatagtcgatggttaactcccaaaaactaagcaataatgtgttccatttggatcatttcgaaccacattattcagtataattaaaatataatttttcaaactcaaccaaaccaaaacatatatacacatccctggtgtattatgattttctttttctttttgtgactagtaaaatacaaggaatgtatgtgtgatcccttccctcttctcaagggtgaccaacattgaaaatgcaagatatggtgcaccaagaatacaataatgtgagatatgatctatgagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaactactatctttcaaacattgtcctttaatttctagatatttaacaaggacaaaggtttatataaaatgaaataaatggtcactaaactctgcacttagttttattttaatcacgaaattttaatttattttatttcaattaattagtttcaatttagtcactttttaaataagaaattaacacgtaacaaaaacaacaaatgagaaaagaataattaagaaagataaatatgacatgtgaattctttattaataatatgactaaattataactgaaactaaaactgaataatcgaaaggaaataaatcaaaatcttatgaccaaaataaaactaaattcaaagtttaataaccattcataatgttatctcaaaaattattatatgatgataggattccaattagggaataaagagggctaagttatttgagttagacattggttaaaacttgatatgatgaatgatggaacatgtatgctatattcatattccatattacataaaatcatgtccacttattttaagggtacgaggttataaaaccatcatagtttcttaaagatgatgcatctcttctcaagtggggtttcaatataaattaagaatctttgaaattctcaaaggatttatgttacaagttgtggcaatactttttttgatatagattttcagatttcataattgactacattttaattaaaattatgtttgaaggtcttaccaacctttcaagtatatagacttctcgtgtcacctaagggcatattttggaagaaaaaaaaatttaagaaatattattcttgaaagaaagaaataattaaaataaatataattaaatcttgaaaatatatacaatataatattagatacataaaatatttatataaatcttaagtcacaattgactacatcgtgaggttcgtgttttttagtatttttatttttttatattagaaattggtgtggaggtttggtgtaatcaataatttgcatggaagacatcactgccccataagatgacaccgttttaatgctgaatgagggtgtgaaaggaattttcagtattttcctatgtaatgtcaatgttgcaatttgtgaaagtattatttaagattgattttaggatgtaaaagtcagctccaccctcctttttgcatgttttgctcaatgaatggatatttatttatgggcataataggaaaaacatgacaattagtagtgtgaacgcagcaactgcattgctatgcgacatcgtttttgggagccatttgctggcgaggaaatgagcaactgatctttcaatttgttgaaattgatttcaaaacactattaatagtgttttctcttctattatatatatatatatatatatatatatatatattaattaggtatatactttttttaatatatatacttattttttatcaataaattttttataatatatttatttattttcgatacataaatattatatagatgtattatttatatatttgtatagttaatttattaattaataattcacttttcttaaataatgattttcaatttagaaaaaattattataataaatataatattttattaatataatgatttataatcttaaaaaagtatattattaatcatataattattaaattaagaaataaataatcttaatatatatgtttatttatgaaaaataaataagttagttttgtaactatacaataattttataaaaagtccgatcactccaattggcatcaccaccttagcggacaatcacctccaaaaaggaaaattaatttgttgaaaataaaaaattgtaaaggagaattgcatgtcaaagaggccaaatattagttggttcgggtggcatgcagagaagagaaatgagtgtacttagatgttcttagggttttccacctgaaaattattagggtaatgcagtatgattttaatcatatatgagggcggagattttgattttgggtagctacttcttaattctatgtttttcctttcatttaaaattaaataaaacaaattttattataaaaaaagagaaagagaaaagaaacgaggagtggaaaaagagtgaagtttgtctaatcaagttgatagatttattgtttttgtttggttggcgagaaaatatatgactgaagaaaggaaaaatgtaggagtgtgagaaatttgattttagtgtgtctttctttagttgtaaaaaatttcttcttggctggtgagaaaacgttggaaaaaggtgagatagttaagtgaatggatacttctgctttcttgtaattagccattcggatgagaagtttgtgtttacatccatttcttggtaaaaaactgagatagttaagggaatatctgtggaactttgtcaattatataataaacataaaagcaattgctgtctcatgttatatagcagctaaactcagaatggataaaagaagaaactgccatgttaccatactcgaacgtttgttgtttgatcaagtgggaaaacagtaaaactactgttatgcatatctttatgttcgggagaaggggtatcatgatcataacatatctaaatatttcttttccccaaaatttgcatgacgaaaacaagtcaaaagactgtttaaaggagcaggtgaaaggggtatttatagtacaagtgttgtccaaaactaagggtgtcccacggctctgctgccttatttagctgcccagttcaaagctaccactgtactaacaataactagctaagcactttgcgtttttataacctaaaaaaagtgacttactttccacccttaaacaatacccgtatatataatacaaagaaagaaactttgattcttattccgaagccatcaatcaatcttctcaataccctataatcgaatgggacttatagggctttctattgagtataaaataaaataaataaataaatttatgtaatttatatttatattataaggatgggttcgataaaagaaaagaaataattaaattaaataaataaaacggttaaaagaattattgaaaatcattctgtcgtgcgttaactcgaatattttcattaaaagagaaacaatttcagtgtatatcaaagattgtttaactataatgtgggtttttcttttttcctttttttgttgagaagagtaaatgagattatgaaattccttagctccactggtggcctaatagttagtacaaagataataaatgagtggctatgacaataatgatgattggtcatgaaggtacttgaatatatatagggtaccatttatatggagatagattttgaggtgggattcaaaaaaatcaatgagatcgtgcctaagttaaaaatgaatctagcagctagcccaaagtaaaggaatgtgtagagctatatgacaaatgctcatcaagatttttggttctactactaataatcgagtgttcgggggaaaagagcaaagccgtcacttcaactcatttgtttcgtcagttgatctagaatatttttgattctactgccaataaacgactggtcgggaaaagaacaaaattataacttcaactgatttgtttcgtcaattaatttagaatattttttattctattactaataaacgagtagtcgaaaaaagagcaaagccacaacttcaactcatttatttcgtcaattaatttagaatattttttattctactactaatatacgagtagccggagaaagagcaaaactataatttcaactcatttgttttgtcaattaatctagaacatttttagttttactactaataaacgagtgattgggaaaagagcaaaaccacaacttcaactcatttgtttcgtcagttaatttaaaacgtattggctagatccttataggtgttaaaattcaaattcgaaatcttggttaagctataaaatgtcattactatctcatctatgtatttttggatcaatatattatatttttagaaactttaataaaatagttacatgtagtttctttttatgatatatgatttgaattaattgctatataatttgtgtgattttatttcttttatctaccatgtcacatgtagactaaatcaattactataataatcattagataatttgtttcattgttttttctagatgagtgaatttctttccttattcctatgtcacaccagcagtaaatttcttttgatattccattttttttctcaagttaactaaaagaggttaattacactgagtatcagaattttgaatgaagctaaaagggttccacttagaaaggaggatgggagggtcgatgtgtaaattaattttctttttgaagggatttatgctaaaaatacccaatataaataattttttggggaggcaggacccgccagcccccttggcctcctccttggtaatgcgaggctaatgaattgaattccatgaaaagaaaaaaagttgtagaataatgttatcttaataatgatttgcacgtgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaactaatattttaaacatttttgtcaaactaattgaactaatagtttgactagtgaagataagctctattagtataaaaaaattaaaattttattacattttaattgtcatgttaattcttctaattctgataaatttatttaaaaatataaatattttaataattttaatcaattaattgaatggattaaaattacctgatgtatggaaacaccatcaaggttagtcatataaattaatgattaaaggtatgtttagttcagctgatcaatgcagttggtagttgatagctgatagatggtagctaatagctgataaattacaccgcttgataaaatttcattagtggttgttgttagtatgttagatgactattaatggtataaatttatcgttaaatatattttattttattatattatatttaatgatacaaattaattgaaataatttataataattaaaaatattatagttaattttttaacttaattgtatttattattaaaaatatttataataaatattttaaaaatagaagtttaatactaataaaaatttataatttcaaataccataattataagtattataattatttaactattaaaagtaatttaaaatactaattatttattataaaatataaaaatttaattatatgagatcaatttaaaataaattattattaataaattttaataagaataataatatataaataaataaataaatcaattgaataaattatcagttgataaaaaaaattaaaataaaactaacataatcagtaactaattgaaattaaattaattattaactgttattcttttaatttttactaataatttaacataaatatgcgataaaaaacagttatcacctctttcaaagtctgaacctcaccctaaaatcctttagccatttgaatgagcgattcagttttccgaacgctgcatttatctgttcattatctatataaatagtactgtcaaaagatccacaaaatctgcgcagtccgtacaagccatttaatcatatataaaattggaccggctgtagatattcatttttcaactttaggtaagataatatgatggaaagtcactagtatacatagtgaaatactaataagtacccattgtttccctgtctttttctttattatctcttcatattttcttttttctttcctgtagtatatgaacagaaaacttactgttacaaggattgtatataatccatagattaaccttgtgataatttctcagaaaagaagaagacaagggtttatgtaataagagattctacattacttagaacataaatttcctgctcgcaaagcagcaacatcagtacatagatacatataaagatctccacccggcttattctagctaaaacaaggttcccattaattttttttttttttttttggctttttttaagcactgattaagattcaaacacagtgctactatatctacatttgatcatatatataatactttaaacagcactgataatatactaacactaatactaatgataataatgacaatatcagttgatgccgatccaagagtacgtagtaccactgccactggtttttatttatttgtttatgtcttctctcttcttcattagcgtcttcttgcagctgtttctctttgagcattaaagaagacagctgcaacaggcaggccaagttcattttcttctgcgaattttcttgaattaaacctatcccttgatgttggtggttttactgtttgccttctttgttgcttgaacaagaggaacacaaacctgtgtattcctatgtttggccttggcatttcatagctcaccatttctcttcctgttgagaaaacagaaaaaagaagaagatgaagaaacccacaaattactttatgtttcttaacacattttatgttatattttgcattttctagctctcttacatattcataaagcttaccaaatgtagcatctgttgttcctgggatgtctgtcactatcctgtaagatggtcaaatcaaaagttcacaagccatgagtatacatgttttgctatatatgcatgttttacagtgatgtactttcatactatttttgtttctacactttgtactgaaaatttatgtgaaaatctggacatgtttatatcatttcttttttccatttttgtactagctagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggtcaagaaatacattattagtgtgtgttgtaacttcttttgaaacttctgccttgttgggagaatgttcttttgttttgtctttaagcactcttaattagccattggtccttctccttcatgttaatcaatcaccctatttattgctttttcttttctttttttcttttgtttcttttgtcatgtgttggagtgggattcaaaatttttactgaatttgaaattgtccatcttaattttgttgtttgtttttcctttttctcgttccttttgtttctataagatcttacatttcatatacataatatatatatatatatatatataaatttataacatctatagattccacaaattttgtaaaatattagtattaatttcagaataggatccaatgattaataaattaactataaaaaaaagatctagctttaaatcaaacatattattagtttgtattaagttataaaagaaatagagtagaacaatatttttaaaaaaagaaaaaaaaaaacaataagctgtatttgattcagttttacacactcgattgcattctcaaactatttttatagttaaaaattaccctctatattctaatatccaaacaatttaaaagtaaaataacaatgaaagatcattacgattactaaaataaattatatactataatcatactgaacgaaagtagtttccaataaatttggtaaaataactgtaaattaattttttttacaagaatttcagataaaaataaataaaatgatgaaaaattatatattatatagttacctttaagcctgttatcataaaataaaatgataaatttaaactgaaaatgaataagcttatatatatatatatatatatatgaacttacatattattcttttcctatgggcatcatttggatgtagaacagatttgacggatattgtcataaatatatatattcttctcgagatagcccttttttatatgccaaataatgatttttctgacatttcttaaattgaaactgattcattatccatatactgttgatgtaacagcccaaattcaacacttctaaacgatccatataacaatttttcaaaggatttaatcattaaaattttaaattacatgttttatatacatacataataaattatccccatttaacctcattattattattattataattattgcccattaacctgcttgcttctgaaattattggaaaggagttcttcccgtctcactttccttctggggtccttttttctattaattttgttatcaagctataatcttcttttactataaataaaaaaaaaaaggatttatacttcagaattaactcgagttaactatatatttataattaaattaaatttatacgtaatataaaaaaaaaattattttcggattttcgatttatatctcttacaaattttaaaatatattatatttcattaaattttcaaactatatatcattttcattaacatcaaaagacattttgtctattgcatggtctagaacatggagaagtaaggaaagagaatttgcattttgaaaaagtacttatagatcagagttgaaagaaaattcaagagctattttggttttgaagtggttcaatattgtatcctctgcttcacatttggtaaaaaaattaatcttaattttagtaaaattaaaaacaaatttagggatgtaaaggtcctaattgaaggaagaagctttagttaactataattctgaaaccaagaacaagaactggaagacatatggtgaaaactgatcaatagaagagttaactgtgaaagttaattggctgtatgcctttagaaattaagtcttagattttgcatgatataattgtgtaatgcatgcctgaagttaatgtcagtgtgggaaatcttttatattcacatatttgtccacatattgagagaaaattaatgggagaataaagcaaaatgaattgatgtggtagatgatttgacatgctctttccttttgtttttatgtctaaacaatttggccaattggaacagatagttttttatttattaatactgtatgcccaattcagtagggttccatcttgatatgattctgatttaattattactgaaaagtttatattgtatcacagtaacaaaatatttttagctcgatattaaagttttctattttttttttctttcacttttgaaataattttttaatatttatataataaaattagtaaaaattatttttaatgcatgaccattattattattattttaattataaaattaagttgatagatacaatttaataaatttttaatatttaaattttaaaaaataatagtaaactaattattattaactatttttaattttttaaattttttaaattttattaatataataacataaaaattatttattaattaatttatattatagaaattaatatatcaatataattaatattactatattttaaaactaacaatttattatataaataaaaaattaaattattattcagtataatattaaaaatataatttaagatgttattttctagaactagaattattatctaattataaaattaatttattagttaatataatattaaaatataattgatatgttattttttaaaatagatttagtattattgtctaattagaaaactatttattagttaatataatattaagatataattaatatgttatttcttatgattagactccgtgtttagttagaaatataacttataaaccaatagattaatagaaaaaactataaaattacatataaacttgaatcttatgcgttaaaaagtaaatatacatatcaaagtaaaaattatatgtgttaaaaattaagtatagaaaattaatttttatatatatatagatttcttaagattaaaagaacataaaaaagtatagaaaaaaattggttaaggtaaggtggtagagagaaaaagcagagtggaaaaaagaaatatatgtaagattaatggggagatgaatgccatgtaaaacctatggtattaattaaaataattagttaattatttataagtttataaccctataaatgaaggtaaatactattattgttattattatccatatccaatcaaagagcattgaaacattagagatgttaaaacatcactctaaccccccttcttacatgtgtaaattattcctattatttatattttatgtttgtatacttttgactttgcagaatttaatgtggtgttgtgggtatccacttaagcaaagtgttgcatttttttctgctcaattttccaaaacatgatcataaaggctgctaagatattctcaagctggggaactatttaattatggacctttgcattaaaaaataaaaagaattattaaaatatttgttgttagaatctttcctgaatgtgctatttactaaggaacttacttcatttggaaattcctatgtttttaaataattttatgagtataaagcaaactccaccataatctcaaaataataatgataaggctgctagtgctttgaggtcatttcaagttaaagagattcagattggtgtcattactattttagaactctgtgattggtaaaagaaaatgcctttctatatttggaaaattcattaattcatttttcttcttcttgggctgcattttgataatgtaaattaaataaattactccattcttaattgcctcttttaatcagcttttttagaatgtgctattatctagtttttgtgccattaccatttgtgttgctatatagtcagcaaacaataagtggatgctttgtttggataactaaaacaagtatatatatattttgcaggattcctccaattactgtgtttgataaagctgaatatttattcaatttggagactctttagactaggtatttttctctagatgttttgaatataatatcatcaatttgaactttataatggattgctgatgttaaaagaaaacaaacccaaaaataaaaataaaagtctatagtttggcttgaagaataatttttgctgtaaatacttatatatcatattaaattgacaactaaaattagctagtatacaaaaaataaattaataataatcttaagtcgtcgatgtaaatacgaaactgaaacggaaattaaatttttattttaaactaaattataattagtctaagaataaattataaataagatatattttataagaaatcatgtttctcttcatttatagcaaattgtattcttctatcaacatattattaaagggttttctgaagtaccttatgccactttactattataaaatttttatttttaattatagataatcaatcaatgctattttaaataatctattagtttatatatattttttactaatttaaattgtcggttatataaccttaattatttatataaattaaaattatatatgggtgaattttatataattaacaatttgctattagtagtttaaaattaatctaaagtgtattgggcagaatttttacgaatgacaaaatatttttaaaaatatcttaatacagctatatatctaaaattcgtactcaatatcttaataagtttcaagttcaagtctctcttctcttatttataacaaacatattttgtcataattaatacaactttatttagtgataaaatcctgaagtaaatactcatcatatagaattatgaacttttttttatcgtaattattttacatattggcgagtataatttatttaaaaaactttccatttagtgacatattaaaatcttattagtttaatatttcactgactattatatactaattttacaatttaattaacgtaataaactaataatttttcttttactatttgtgtttgtatatttatataaaattggaacaacctcctttgttttttcatgattcccatctataaataatagctaaagggcttaaacctaagctctagaactagactatcaattgacattttgatggaacatatagagttcaaatgaaattaattaaagctagcttagtctaattgtttttaacttttagtttctgaaaagcagatacatcagtacctatagacttgacctaataataaataagtaatattaccaaattaaatcccctttctctcatttttatttaaaaaagacatataactaaaattaaaagtacaaaagaagcatatgctaccacaaaagactgcaactttgcccaaactagtttttggcagatgattcctccagccatatagtgagtggtctttctttttctattcttttaatttatggatttgacaagaataagggcattatgttcttataaaacagatatattatttttcaatggtaccaccagtaatggtgaattcatgtgcatttgtacatgaaaatttatacatgaaattgatttgctagaattaggcaagacatagagtggggtcattggggggatactttcttttctgaaacagtttcagtggctttttggaagtggagaagacagtagattatagatttataatctcaaaggtaaggcatataaataaatcattcactaattaacaaatttatagattttggtttaattaaattacccaaaaataacaaaaaaaaaaaataaaagacaaccaagaccctaattttgaaaaagaataaataaataatcgtatttttgatattttaatacagtaacaattaaaaaaaatattaataaatttaataacaggagaaaaaaaaacatggacattttttattttcttccaagaaaaagatttacaggcaaggcaaacattccccattagctactaatatgactattgagatttccaattgtttggtggcccaattttgccaaggctacatttggttcggcctatatcagttggtagcctaattcagattctagggtccaatcatttatgcagtcatgacccacattttcacatgggccttctactttgatgcatcagacctttgggtccttattttcagcccaaaatatgtaataatctataaaggtcaagcttatatgttcatattggtccgacccgataatagaggaaaaaaaatatattttatttagctcattctaaatgagtaatcacacttacgtagacaagctttacttttgaatcatggattcagtctcgtaccaagacctgttgaaatttataaaaaattttattttatttgagaaaaaaaaaaacatgagaaaataaataaaataaaaataattaaatcgaaagagattttttgatgttatgaaatatattgatgtactaatgtgaaatttattagaaaattttacgtataatttagtttaggtataaccaattccatataaatttgattgtgtggaactttcactccatttagagcacgtaaactttaaatttgtaaattaattccatgaattttatagatttcagccaaacacggtattaatgctatgtttggtttaaatccataaaaaaaaaaaaatcatttcatttgataaaaagacacaagaaaaaaagtaaaactagaatggtaaaattgaaatagatattttgatattatagaatgtattgacttactaatgtggaattcatttagaaattcgatatgttttgttagaatttagtttagttataattaattttacacaaatttaattgtgtagaattttaaattgattcccatttcatttaaagtatatagactttagatttacaaataaattttataaattttgtaaatttcaactaaatataattagaattatctttagagtaattagatattaatgttactgactcacaattttatttatttcttttaaactaatggacagtgatgtgaaccatctttaattcttgagataaataaaaaacaagtaatacatggttttactattttataatttttaatatgttgtattttttaaataaatagagatacgtgctcacagatcgtgacaaaaaaagtatttcacagttaaaagttaaaccatctaaattcagatcaaccatcgttaattattctattgactataattatttgattcataataagttcacatatactattaatgtctccaaatttttttgagaaagaaaaaaatagttcgtttggtatttttacttgtaaagagaattcttgagcaactaatattattgatatgatttaaatataagaatataaacatttccaaaataagctacaattgacttgataggtaggatatataattctgtggctcttatcctgaaatgtcaagattttttgtttcttttaattcaaaagagatatctgaaaagcaaattgcaccaaaagaagtaatagtgaatatagaagtaatgaccataaaagatgaaagaactatagtaagcatttttatttgagaatctttcgctctattattggaaagaaaaagaaagattatcacttagtaaattaacttgtcactatctctgatctcccatcatgtggatcacattctccaatgggtccttttctttttattcgtcttgtcttctagaatcaagaactataaagtgttttaagagttttgctgttataagcttagcttagaatggtagttggatcaacgaagaagatagcagttgcttcagctacagctcacactagaagaaacaaagctacacccacttctttcccactttccctctgtatgtatgtattttcttttttttcttttttttttcttgcttgtgtctttacttcttttggctatgttttcttgtttcaatcttgatttctgtttgtgggttctgttttagtttcagctctgtttcgttggtttctttctgttaaagtctgatgtgtttataagtttaggagtgtaagactatgtgtttgtgtatggattgatgtgtatcttggaacttcaaggtgttaagtttgagatagtagttaagtattacatggattagattcacatttcatactattgtaaaactagtattgcataccagatacataattcttgtatttgtgcaagtatgatccaagattatgttttaaatacagaaatgaactcagtgttaattagcttgattttagaatacaaattctgtctagaaaacccaattactaaagtgtccaaaaccaggtttttggtgtaaacaaattaaagattttgattgatttgtactagcatagtgctctgcagctaaaatgcagctacatttctctttcttgggcgcaggcttttatttaagataattatccacactgaatgtccacttcttaaattctttctgacttttgtaacttccgtaggagatgccttctctgtgctatttccttagctctcagttgatggattttctagttttgaatgccatgtatattactgcagtaacagtgaggttgctgcaaatcattaaaaacaacattacttaataagttcttcaaacaaataagagcatttaccctggatttaagtttcttcgtctataacaaagtaatcttaccttacatatatcgcctgtatttactgcatctgttaccttgctaatagaaatgttcagtctttctgtccagcaatgtttgtaccaatagcagtgactgtagttgtgggtcttctgggttttgcctatcagtcgttgaaacctccccctccaaagatatgcggatcgccaggcggtccgcccataagttcaccaagaatcaaactcagcgatgggaggtatttggcctacagggagaagggggttcctaaagaagaggctaagtacaaaattatcgttattcatggctttgacagctcaaaggatctggatttacctgtctccaaggtacagactgaacgcactcctgcaatgcttgcatctccagtaaaaaaacttatgaatttgtggttatcttgcacttttatggcattgccatgtgagtgacaatgagcttcaacatcttgattactagcaaagttggtagtctagcagattaaataacgagttgtccgactctgatgcaatatccttgaacaaaaaggctgagacagactgataaaggctagaaagaaaaaggcttttaggtgtgactagtatcaaattggagtagtagcagttttgaattgtatgattaactttgccaggacaaaagaaggaaaatgaaaataaaaggttgtgctttatctgctgtggactaaactaattcatcagtatgctttgatgttcaggatttcatagaggagctaagggtatatttccttttgttcgatagagcaggttatggagagagtgatccatatccatcacgctcagttaagagtgaagcatatgatatccaagaattggcagacaagttgcagatcgggccaaaattctatgtaattggagtatcaatgggagcctaccccatatacggttgcctaaaatacataccgcataggcatgatactttttactaccagcttttcacttaacttttgaggtttttgaatgcttgggtttcagtagtaacaaaaattcttctaaattaattacaggttggctggagcttccctcgtagttccatttgtacactactggtggccttgtctcccacccaatatatctagagagggcttacaaaggcttcagaaatctgatcaatggacatttcggattgcacatcatgcaccctggttgttctactggtggatgactcaaaaatggttcccttcattaagtattatgtcaggaaatgtagcaatcttttgcccacaagatatagagatgatgaagaagttatctgaaaccccaagtgttgttcaggtagttaaagttgtgatgcagcattagcttatgatattttggtatttgcattagattcgaaatgcgaattcttgtgttgatttctatttcaagtacatttactagcaattgtaacaatatgttatgttttggaatacaggaaaaggttcgccaacaaggtgttcatgagtctctgtatcgagacatgatagccggttatagcaaatgggaatttgatccctcagatataattaatcctttccccaacaatgaaggctcagtccacctttggcaaggttatgaagacagaatcattccttatcaaataaaccgatacatctcagagaagcttccatggattcgctatcatgaggttcctgatgctggacatttattgatcttcaggagtgacatatgtgagacaattcttaggtcacttcttcttggatgagctgcatatgtcgtatttataggcctgctctgtactgtatctgttattaaatactgtacttatgaatcctctttgtattattttacctttgactgcattaagttgctggagttttctgctagatgtgttcttgcagtaagcagctggtccaagctgtaagcatatgacagataataaagaaagtggaagaaagtaaaaagaaaaatgcaatcgtgaattaaatgaccttgaaacttgccagaattaattttactttgttacattaattagaacaatttcaaagttaaaaaatctataattatatgaaactccaaatcagttcttcgaacctttctaacttgtcatcatgcccttggcacagtatgcttgatgttataaccaacaatacttgccggtagctaatggctgtaagttccacctgctccgacatgcttcattctattcaatgcttagtaaaaatatctgaattttcctcggtagttttgaacttggaattttagttagatgtataagttattgttaatgttgttattattattataattatattgaccctatcagaagtaattgctttctgtctcattgtagaactttattttggtcaaattttgagaaaggttcggtagaagtagtgtcaagaaaatcaggtactcaacgaccaactaagagtcagacagaggaagtgctgttagagaaacacctgactcatccttaaatatgagatgaagctagtgaacccactaatgaagtagaaaaaagtcctcaagagaaacagaaattttgagtttgatttctatttactgtgcctttcaaacatgtttactgttgcggcagcagcagtggtggtggtgagtcttgcagtgttaggatacgaaagggtaaagcctccacctccaaagatttgcgggtctccgagtggtcctccaattacttcaccaagaattaagcttagtgatggaaggcatttgtcttatagagaaaggggtgttacaaaagaaattgccaagtataaggtcattcttgttcatggttttgatagctctaaggacatctacttgccactatctcaagtatgatctctgcgtacacattaatgccatatattagaatttgtattttaattaggaactcttgtataacttacatgtattagtatgagagctttgtaagtctccacaatttcaataaccgaagaagataatttcattgattataaattgcaggaggtgatggaagagctaggaatatatatcctgacatttgatagagcaggttatggagaaagtgatccaaacccagaaaggtcagtgaagagtgaagcatttgatatccaagaacttgctgaccaaatgcaactgggtccaaagttttatgtcattggagtttccattgggacttactccatttgggcttgcctcaagtatattccacacaggcatgtcactctttcccctactgcatctccacatttatttcttctttacattattttttcatttttgtcgacaattgttaaattatgctaatgcaattaaggattgcactcgacagtagcccactggcatgatgtaaaaatctaatccgaattaacaaattgccaaatcttattgcatttctaagtgttggatgttttctgtattaacaaaatgttgatttctgaccaagattgaccacaggctagctggtgtgactctagtagttccagtcataaatttctggtggccatctttccctcctaaattggcaaatgaggcattcaggaaacaactcaggagagatcaagtaaaactgaccattgcacatcacttccctccactagtgtactggtggatgactcagaagctgtttccttattcctctatcatgcaaagacacccaatactactcaatccaagagatttagaaactataaagcaaatgtctcaagtgcctaatcctgatgaggtatcttcttctcttccccattttttcttgggtacccataatataaaatgagtttttctttttaagaagagaaaaacgaatacgcatatactgatgttgattcctgaaacatgcactacggttttatttgaaatgattggtaatgtttgtaatgacagcataagataaggcagcaaggtgtccaggaatcactacatagagacatgatagtgcattttgggacatgggaatttgatccaatggagctaaagaatccatttcctaacaatgagacttctgtttacctgtgggaaggtcatgaagacaagcttgtgccatttgaattgcagagatatgttgctaagaagttaccatggatcaaatatcatgaagttcctgatggtggacatttgatgattcatgaaaagggcttgtgtgaggctatattcagggaacttttgcttggagaggaaccctttttttgatgttcatcggtaacaacagtgactaaagcatctagcaaatagctttactggttcagcttttttgtctaggcttttggaatttgtccaactgcaactacacccaagtttggttatatatatatatatatatagctgttttttcaataataaagagctccaaaatcgagatatacgcttactattgggttaagtttgtgaaattctttatacttcctttttcaagcatttatatcaaaaagaacaaaaatactaacaaaatattctggtaaaccagccaagccaattgaaaaaataaataaataaaaacaaattggggcgtaacaaataagaccaaccaagctatgaaaatttaaaatgctctttacctcgcaaatcatcatctgtaagaggtgccactgtaaaatgatcggcaaaatcaccatcagttcgaatgaaatttccaagaaataaaaggacaaagttgtaagaagatacatcatttaagatgagtcactttagtccaattataccataaaagcaagcctctacctaaaggagcagccaaagtttagtccaagctcgttatggttgattattagcaaggtaacggatgcagtaaatttctttttattttcactttaaaagcaaaattttacctcatggcttcaactcaagacgttgatgcctgccaaagggcattgggattgggacccaaattctagtgtctcaagtttttactataaaccagttctacatatattataattcattctaggtactttaaaatttgttaggttggacagactaccaacccatttcatatatatttataattatccaccacatgaattattgattaaatctcaaatgaaaaagtcatgtggaccaacatattttatgcattacagggtgtaaggataccattcattcttaacaattaataacttgagattatacactgtctatggttccctgacctgattcaccagcaaagcatgctggtcatgttacaacaacagtccctgtcggtgagaaacacaaacactgtccaattaccaccatccatttattaatgtgtcaaatatttgtctttcttgttctcacaaaaactgtctaaatctttaaaagtagaatagatttagcttgattattaatgggttctgtactttaaactgcctgaatattcaatggtaacctccaaggagttgtgtggtacttttcgcgataaaaaaggtgcagttattgaaattccaagattgataatctaattcacataattttgactcactgttcttcaaaaatagttcggcacttcagagaatatccaaatgcattttggataagaaagaatatccaagtaaggcataaggcataatctaattagaaatacctctcaaccaagagggagacagcatcacagttattaacaaaggttagcagcaataaggagctgacactattaatataaaaaaagaaaaggggaaaacataatcacatgagcagtcaccacccaccaactcggattactgagcaagttaaaagtcataagaaaacagcaatgatataggctcactgttccaagaggtcaaaattgctgctgctggctctctgcagataccttggcaagctaggttgcctcaaaggatcaaaagaaaaaaacatcagaaaaaggaaactacaaatcatcacaaccattggattccttgaaatttagcataatatctgtgaaagtagtgtcaggtactattttcaagaatctttccttttcttgctttctaggatattgtcatgctgctagtgaatcttgaattatgctagctagatctatcttttctattcattcaggaatgcttttaaaaatagcagttcttctgatgagtggtcttctaggcatggtttatcaggctacacagcttcctccacctcagaaggaagagtcacaagaaaatactcctgctaattcaccaagaatcagactcagtgatggaagatatctggcttacagagaaaaaggagtcaccaagaacaaatccaagtacaggatcattattgttcatggctttggaagctcaaaagaaatgaactttctggcaccccaagtacaatttttgaactctcttctctaactttactttatattaaactaaaaaaacttttcacattttaatttgggattgctccattgaagcatagggaccgagatgatgattcaagtgttgttgggtaaacaatattgagttgaatcaaaagttcaagaggaaactgtttgaatggatagaaattgcccaaagacagcactaaatcctatatttactgaactgtctatttaacaaaccagttctcatttcaagttcatttagaacttctcatacatttaatgtatagaagtgattgtgatcatacacacctaaagacatatggggtggtcttatataaattctgcttctaaagattctgttcttatgttcatttaggagcactacactacaatatgaattggtaaacctttccgcttaacaaagaattacctgcttgcttgaaaacctgtaaatgtataaataaagtgagtttcacattgctttagttttcaggaactgatagaggaattagggatatattttctgctgtttgaccgagccggatatggagaaagtgatccgaacccaaatcgaattgtaaagagtgaagcgcatgacattgaagagcttgctgatcaattgcagataggatccaatttttatgtgataggagtctcaatgggctcataccctatctggagttgcctcaaatatataccacacaggcagattcaatcagaacctctagctgcaatgcatagctttctacctgaattttgtcaataagattcccattactcacctcaaaaccacttgtgcaggctagcaggtacagcattaatagccccagttgtcaattacagatgggcttcacttcctcagaatttgataaggtatgattatagaaggaaacttatccagtgggcactctggttctctaaccatgcccctggattattacactggtgggttactcagcaatggcttccttcaacttctgtcctggaaaagaacccattattctttagcgatcaagacttagaagtcttgaagaagataccaggattccctatgttaagtaaggtaactatacaatgctccacatgcatgtaaagaaagaggacaaataatttacattgtagtatttaaattctgatagtttgtgcttccaactacaggaaagattaagagagcgagatgtttttgataccctccgccgtgactttatggtgggttttggagattgggaatttgatcctgttgagctagaaaatccatatcctcaaaatgaaagctctgttcacatctggcaaggctacgaagacaaggttgtaccatttcaacttcagagattcataacaggaaagctaccctggattcgataccatgaagttcctcaaggtggacatctaattgtgcactataaaggtttctgtggggctgttttgaggtcgcttttacttggagaagaccctctagaactagaacaagttcatccataaatttgttacatgatcatttcttgattcaaaatgtaagtagatggggtttagagaacgtagcatgttgtcagattacatttgttatttgaaaggttggagccttttcttccgtgtgtgtatgtgtgtttgactgagtggctgcatgtgtaaatatagaaaatgttcgatacaatgaaaggctgtgcattttctggtgcatctgaaattgagtcaatataacaaaggaaaccatgagcagatagaattatgtgcactggttcctagaataatggtgaactataagaggaagaaattatccaagagggcacactatgtttaacatagaaatatcagtgaccaatctggtgtagcttaattagtacgaattcatcactatggctttaaggtgtctgagttcgaatctcaggtagagttggttaatcgaacaagaaaagaaaaatcagtaacagaaataactggatttcattttcagtaggaactaactcaattacaaaagctttgtaggtgctcatgttggatttggaatacaagaacatcatactccatagatgatgaccctcactatcgtgtgataccaacagcaaggagccttccaaaacaatgagagggcataaaagattaacattccctttcataaaatttatgtgcatacattttatttctagtctctaaatttgactttgtatcagagagatttctatattgtacttagtaatactaatattattttatctaatttttacattatttttcgttatcatattatcttaaattttcttaaattataaaaatatcgaagttatgttaagatgtatatatgatgacacattatatcagcaataaaatttctttcaaatgattgtattactcaaagtttttgtatgagaaaaaacacatttaaaataatgaattgcaaccgtcgtttattcgtgcgttttacgattgttgttattgttttaattataaaattatattataatttaataaaatatttaatatttagtatttatttgtaatttttttaaaaattagagctaattaaatatttttatatattatttttgattttttaactattttaagattttattaatgcaataatataaatattatttttaaaatatatattaatttattttagtattatataaattaatagaattatattactattattttaggattagagattattatataattaaaaattaatttattaggattagagattaggaaattaatttattatctaattaaaatataattaaaatactatttttagaattagaacaatatttaattaataaattaataaaaaaattattaaattacatataaatttgaatttaatattaaaaactaagtacatatgtcagaataaaaatatcatatatcaaaatataagcacatatcaaaaagaattttatattttaaaaattaacatatatatatatatatatatatatatatatatatatatatatatatattacaattagtacaaaagctttttctgataactggattagccgtaatattcttttatatgcctaggcataatctatgtctctaataaagtccatttgaaaaagcatctcacctgtaattttcttaatgaagttgtagaatttaatgaaattagatttaagagcattctcaacactactttttattttgaaaaatgatgtttataataaaagtatatttgtaaaaaaatatctaaaataaagtataatagtgtccaaaatgggtctaactatctaatttttcaattctcaattttcggatcgtggagtatagcaacacaaagctctaactgctacagcttctaatttgatatgacttttaatattctgcataacactggtgggaagaaataaagatgagtaaaatttattgagagaataaaaaaataacaaaatgaaacaaacaacgatttaacaaaattcatacaatactatactatttttgaataccttatactagagaaagtattgctattattcttaatataaatattgggtcaaaacattttagctggacaaataaaattttatagaactaattaaatatagaatcactttcataagtatcaaaaactgcaaatcattctctaatttgaaatcaattatttacatagtctcgaatcaatccaaaaaaatgtcgatactagtttaaattctaatatcataatttaaattctaatatcatatcaagagaaaataaaatagttaaaaaaaataatttagtagaaactaatatatattcatagatatatatatatatatatatattgatccctagtaactttggacacctcagacgtctcacctatgtagctttcaaagtgcaaataactaataatttgcgcgtaaacaataagccttcaaaaggcaccacctagcatacgttctaaagacgataagtataaggtgtgatctcatatgtcacataaatagatgtatacttatttatccagctatatacaattataatcgcatataaaataaaatcaaaaatatcattttctatttccaacttctatagaaaatattaagttctaaatagcaattaaaataattaatttttagtagaaatattttatcaacttctaaagagcaattaaaataactgatttttagtataatattttagcaaaccataaggatatagatataaataaaatattattaaaaaatatgatattataagtttatccactcaattagtatgcataatataattttctttctattattatatcattatttactaataatatattcaagtttaattatagattaatcacttagctagaatctcaattagatataatcaattaattattataatttctagctataattttatgtcctaataaattaaaaaatctaattatttcacactaataacaatatccttgatttattacattttttacctcctaatttatataaattcatgttaataaataaaataaatataataataataatttttaagataaacaatcaccaactaatatttatttttatatattataatttttaattaataaatcttacaattagtttactaacaatttatattaacaaagaaataatcaacagccagtattttacttagacagtctacttatccccagatacttatcgacaatccgagggtacctacgtactcaaaataatacgtacaaaataaattcaacttctacttctccgatcaggtcccaatcatcccgaaacatcagacagtttctaatcgttgattttccaatggagtccgatcgaagcaaaatcgtgttgacagaaagtttatggagagtagagttcatccatgtattctaatcagccataacttatcggaagtggccgaaaaatgagaaaaaaccgaattagatgatgccactgccaataaaagaaagcccacacgacgaccgttcatttaagactgaaatcaaggctcatcatcgccgaaaggaggagaatcgaaggttcaaattttcattctcaaaaaatttctctcttcatttagtctttcctcgccgcgtctcaccaccccaaaccaccactaaaggattggcctcttcatcctctttctatagacaccaaccacgccctctatttcctcctaaaatgtattctaccattttttatcatataaaggaattaaaagaaatatagaaaagagctgtatcttcttcccgtggaagaagaagaagattctccttttctttcttcttcttcgtcccgtatccttgtttagtccttctatttattttattattatttttggccctggttaatttctgttaggcctcttaagtttgttaatcctttttagttttacccctgatttgtatatttcgactagattataaaatattaaaaatataaaattatttatttagttttgcttttaatagtaatattattaaaatactcatataccgatgaattataaaaagaaccaaccatgaatttttttatttaaactctattttaaattatttattcataaataaatatcaatttaatcataatattttattaatttaattaattaatttagtaattgatttcaattaaattcaatattattttctaattaaaatttatcattctctaaataaattcttttataaaatatttttatagctttcaaatataatatttaatttatatatttaatttaaatatgacatttatataaagtaatttactcttaattaatttttaaaaaaattaaactaactggatatagtttattagactccttaattttatccgtattaaaatcctcttttaaatcatccaatttaaaaagaaaacaacaaaaatgagtttttctaatcatatacattaagtttataagacttatgattttattatcataatcatcacaatccttatcatcactattattattattattattattattattattattattattattatatgggtgttacacaaagaatagaaaatttatttaattcagtaaactctttatattttacttttacaaatatttatattttagtttcttttttttctctttttaatctttgtttataaaaaataaaatttaaatattattaataaaatacatataatattattaccttttttattgaactcaaaatagaaaaatttgaatagttcaattgattatttatttaatatttaaaaaaaattatttaaaattattttaatttattttaatttattttataatataatttctaaaataaaaagaatcaatatataaaaatacaaaagctctaagaaagtattgtctttgacttacctttttgagccgagtcggatgaatatctgtactcatgaataaatcaactcataaaagaaataaaaatctttagaaaattattgtacaagttatcttcttaaattaacagctccagtttgaaaactttcatgagcaatactcatattctcaaaataaataagattaaattatctattttattattctttatttcatttatttatttttaactttaatttataatatcttagtttgaaatctattaataaaaaaataaataaactccttatatttcttaaaaatactaaattaagatttttgaaataagtttttttaaaaactgttttatttataaaaaaaaattattgctgaagcagattttgctggagtggtgggaataattcaaaatcaaattagtcttcttaaactaaaagtcagaattttctgcaagacaagactcatctttggtattttctgcaactaattaaagcttatggaatacacaagtcaatgttttctttatactctcttcacatgtggctggttgtatttttaaacttatataattctaattatattgtataacccaatcttttattaaaaaaaaaatgttctttataataaaaaatattgtttaaactgttaggatttagtcaatattagtcagtaaataaaatcacattttattagggactctactttagaataggtatgttcaattagaagtcggttagaaatggactccttattcatcgttctttctattttctttgtacggttatctatagtctgaatcttttccattcaataatagaattccttccataatttctctttgctaaatacttctactgttaatatcatcatttggtatcagagcataggaaacacatccgaaaattctgaaatgttgaactgatggcttgatctcgctccatgcttcttcgggtgttttgtccttcacaactagcgttggactacggtttaaaacgtatacaacccaatttactgcttctggccagaaagttttgggtactttcttttccgatagcatgctacgtaccaaattcatgatagtccgattcttcctctctgcaacgccattttgctgcggcgaatatgaagctgtcagctgcctttgcactccatgttccttgcaaaaactgttgaattctccagatgtaaattctccaccacgatctgtgcgcagcccttttagagacatatctgttgctttcttaacatgcgctttaaagctcttaaaaacagtaaatgcctctgatttttctgccaaaaaatacacccatgtttttcggctaaaatcatcaataaaggtgatcaaataccttttcttactgttcgaggctggcttaattggtccgcaaatgtcggcatgaacaagctgtaaaatttgcgatgctctccaggaacttcttattgggaatgagtcccgatgttgttttccaatctggcagtctttgcatagcttcgagtgtggcttaagaggtggtaaacctttcaccatttcctttttctggaggatttgtaaacctttgaagctaaggtgcccgaacctacaatgccacaactgcgacacatcttctgtaacagtgctaaaacaagtgggtgctataggccaagagataacatgcggaataaacattcgatttgcagacatattagcttctataatcaaacctttatctggatgatatattttgcattaccctcgttgaaacaaaatactcaaccccttctcttgcagctgtcccaaactcaacagattattcttcaattccggaatataaaaaactcctgagataatgctaacaaatccattaatttccaacctgatgttgcctttcccattgaccaccatgtttgagttatttcccagccttacagaatcagtgaattcttcatcaaaattagagaaatactctctttttccacacatgtgattgctgcatccagaatcaagaaaccacatgtcagtgttgtgtttattcttttcttcaacataggccatcagcaacatgtgttcttcaccctttacttgactttcactaaaattcgctactccttgcttgcattcccattggaagtgtctaagcttgtgacaagcataacattcgaccgttgctttgttaaagccttgtctgcttcttccacgacctctgcctccaaagttcccacgccctcttcctcgtccaacatgttgacctccatgagtcaccttcaaagcatgctcttcttggatgtatctttgttaatgttcgtctccagaatagaacgatctaatgcctgaaacaaatagttcttagctttgagatccttcaacttctgttctttacagattttcttttgtgcctcagttgaagctgcaccttctgctgctgcagaaataccattttctactactctagagtactccttcgatcgaagaaaattttccattagcatcgcccaatgactatagtaaccatcgaacttcggaactgctggttgaacaaacgaaccctctgttgccatagctgctgcctgaaaaatctatagaagactgctgcttctatcaagcctttagggaggctctgaaatgtgattatgagcataccctttttgtcaaacgaaacatgaagggaaactttctcattataagtttatatgtcgatgatcttcttttcacaggaaatgatgaattgatgtttactgaatttagaaggtcaatgaagcttgagtttgatatgactgatcttggtaaaatgaagtacttcctgggtcttgaagttctacagaaattgggtgggatttttgtctgtcagaggaagtatgctgaagaaatgttgcaacgttttggaatgaatcaaagtaattctgttcaaacttcaattgttcctggtttcaagatttgcaaggatgaaggagggacaaaagtggataagatttacttcatgcaaattgtgggatgtctcatgtatctcacttcaactcgtccagatatgatgtttgccgttagtattttaagtaggtatatggatagtcctacgcagcttcatttacaacttgcaaagagagtgctgagatatttaaaagaaacgattgaatttggaattttctatagcaagggaggaagtgatgaacttgtggcctacactgatagtgattatgctggtgatttggatgacaggaaaagtacaacaggaaatgtctttctttttggtgctggagctgtatcgtggtgctctaagaaataaccaattgtaagtctgtctaccacaaaggcagaattcatcgcagcggcatcatgttcctgtcaagccatttgttaaagaggttgctggtgacacttaatcagactaagcaagagtccataactatcaagtgtgatagtagttcagcaatcaagttatcaagaaatccagtaatgcatgggcgtagcaagcatatagatgttcggtaccactttcttcgagagcttgtacaagctggagtaatagaattgattcactgcaacacttcagaacaaattgctgatgtgatgacaaagcccctcaagctggatgcctttctgaagctgcgtgcaatgcttggagtttgtgccgagaacacaacataaactgaaattctcttatcagaaataagagaatttagtttaagggaggaattgttaggatttagtcaatattagccagtaaataaaatcccattttattagagaatctactttacaataggtatgttcaattagaagtctcttagaagtggactccttattcatcgttctttatgttttctttgtacggctatttatagtccgaattttttccattcaataatagaattccttccataatttctctttgctaaatacttctactgttaacatcatcataaactaccttagaataaaatgcttttcaaatttaatgtcttaattagataataagtcagtgttttaaaatattttatttattaaaaatttgtttcttattaataaatttacttttacagagtaatttgttcctaattaaatgatgatttcttatttaaaagatattatgttttatacctaataaacaattattttagtattatattttaatattaatgtacattatttttaacatattagtcactattattttattttaaaaataattagcataaataagaaatatccattatgtataatattattggtcttactaacacttaattaagttaaccataaataactcatgatgtataatatctaagctaacacaattactttggagattataaatgaattttgtctacaataatgcttatattgttcctaaagaaaatacccatttggcaagtgaaatatgtgggagttttgcttgaataagtgcatgtttgcaaggtgtcaaatccattccaatggctcttcctccataagtgagcaagcaaactcttaatatatgggcaaaagagaaagactattagatttcttttcattatttcaatctcatgatatctgattttaacctttcttaattatataatactaactttattttcataccttttcatcaataacttaattaattctttttattacatagaaagagattaattaattgggaattatatataagtttttctaaataagaaaagaaataagaaaattttttaaaaaagaaaacgacttaattaataaatgactattttctatagtttagtattcagtcgctcaatttttatagtttaaaataaatgatagttcgttcatttaaccttctattttaaggtaaaaatataaatcaaaataatcaatatatattattacaaataaaaaaaatattaattagaacagaaacattaatagtaaagttataaatctttatatatgggaaaattataatattattatatgaaagttattctataatagtagaaaaatattatattgtaattgtactaaaatatgtctagttttttaaccggcatcataattttaaaataaaatttaagaaaataaaatcgtttatcctaattagctagccaccctattaattttctagttggaaataaacaacaaaaacttgaatttaagatatataattgttaagaacatttcttaatagttaagattttaaaagactttttaattcatactaatttttaaaaatatttaagagtcatattgtctttactctaaaacggatgaaaaagaattttaaaaggattctattattttttcttcttttaccttataagagtcatatacttattttttttctaaatttagtataaagagtcatattaaaatacattcaaaataaattaattacaatttaataaaaaaatataaaaaatattgttgctattaccggattaaatttataagtgcttcgctagcctattaattgttaaaccataaatagttactcaactctcagtaatcaagtgatattaaattaaggaataagtatgaaaaagaacattatgattttaatgtcgtacaatttttagtatatgtattctttcagataataaaagatttatggttttaaattataacaaaaaaactatattttgttaaaaaatttcaatttataagaatttaattattttcacttcaaccatcattgttatgttgcttatatctaataacgtgaatttaaagattagcaactcctaattttattatttgaccgtcaaattacaattaaagaagttactaataagagaagatcgttatggcagtcagataacgatatttcgagttgttcagannnagatttaaatttatattattaaatatagacacataatagagataaaaaaattaaatttcgagttgttaagattaaattcatattattaaatatagacacataatatcatagagatagaaaacgacatttcgaattgttaagatttaaatttatattattaaatatagacatataatagggacaaccggttggagtgaagatgattgaatcgtttttaaccgcgatatattttattttgctacaatttattttttattttaaaaaaaatattaaaattacataaaaataaaactaaaatattccttaaattaatatttgattggctcattctattacccaatattaagtcttaatttataggatctaattacgcctatataattaaggctacatctacatagcagatagaatcaccactcccaccatggcatttccctgtgctgtattagtacagctcccttatttttaaccttgaaattctcattatttattgtttttctctgtgtttttatttggcagtcaatgagatcatcaaaaatgaaaaccaatgagaagccatgcatgcaaataacaatacttagagatggaaaaaaaaaaaaaacaatagagagggatcttttgtaaggcagaaaacaagtggcaagtggcataaacgtgtcaacaagactgaacagaatgtagggaccacatcagtgccatgtattaagggtgtggccatggcagttacattacagtcactcacttctctctctctccgttcctctctttctctgccaaagacaaagaacccactgaattttacctctttctctctctacatccttttttttttcttttcttcttctttatttattgccctttttctttgctttgtttctatcgctttgcttattgctccttgcatcatataattacttctcaagacacaacacaaacatatgtactaacaaaaaagaacatagctttttcattacactgctgtatataaacttgattctttcctcttctttctgctattttttttttcatgcttaaagtcctcttacctctctctatctcgagttgatcatcatcatcatcatcagtttcaggtatatnnnctttcatacactgctgtaataactgatcttcctctcttctgctatttttttcatgctaaagtcctctacctctctctatctcgagtgatcatcatcatcatcatcagtttcaggtatatatcccccatttcccaatgctgtcaatcttttcttctctcatgtgtttctttaatgggttctttctttcttttctttccactttgatcattgaacatgtgtttctaacattgttttcttctgctatatataaacatgtcatgattgtttgatttgaaagggaattgaaaattttggttttggttttgtttcaattaattcttctctttttcttttctttatggaattttcttgtatgttgatgcatgcaaggttcttgagctaaacagcttttttttttttttttcttttccttgtttttctcttgggttaatgttttggttctttaattaatttagtcatctctttcagttttatggacagtcccatgtttcaagtgttctcattgaagttaattttcttctctttttttttaataaatatttaataggtggggtgggcctcattaggaatggatactattgtaggctcccaataaacatttagttgtttattttattttatattaaagcaagctattggttttacgaaatcatggactgatgtgggaacaaatttccagaattcttataaatatcagtagttttatatgaattacccacaattatttcaaaaattagggacagtggcatcaggttagcagaaatatcctatgaatattctcccagaaagaacttacattaatttagacattataattcactacatgactgcagattataaaaactcaaaagcttttgatgataacctcttatattttctgactagaaaaatattctttccaaataatattttgagtttttttttggatatgggtttacagtcaaaattgcagctatggattcttgtttggttaaaaaaattggtgcagtagagtacagtctagggcataaataattgaactttacagccccaagaaataaaggccaacatttaactactgccaaagtcttaaaaaggttgatatggaaataaacttttgccttttacttagggagctttgttttatttctagctttgaatttatgagttcaagaagaaatgatgataattttgtcttttaggtggaaatactattcaattttgtgatgggtcttgctctaatttttcttgcttagggatgaactgaagcttaaattccaatacaattatctttatcatacaagaagaatatggtactttctgaatcagacactattgtctatggcagcattaccaaatcaaactcaccaccattatcacatccacagtcacatttacaagacgagtcaatgaaggatgcttcattttctccattgagtggacaaaattcacttttgtcccttactctcaatgaaatccagcacaagagtggcaagagctttggttccatgaacatggatgagtttcttgctaacttgtggagtagtgtagaagaaaatcaagttactccacagccaaatcaactccagcatgccaaagacaatggtagtgtaattaacctgcctccattggcgcgacaaggctctttctccatccctgctccgctatgcaagaaaaccgtggatgaggtatggtttgagatacaaaaagagcaaccggaacgtcaaaaaccaagcaatattgatgctcgtgagccccctcaacgccaacagacgcttggagagatgacgctcgaagatttcttagtgaaagccggtgtagtccaggaagctacacagtcagcaggttcatcgctgcagaaaatggttacacctattcaaaatattaatgcatgtttggatgcaagttttggaatggggcaagtgatgggaatgggatttcctactgcccatcaaactattggaaacagtttctctaccggcaacggcttcgcgccataccagatgttccctcaaagcaaagggtttataggagaagcaccaaacaatgcgaaaaccgaacagggtcaaacggaattgggcatgcaacaaaacaagaaaaggataattgatggtccaccggaagtggtagtagagcggaggcaacgcaggatgataaagaatagagaatcagcagcacgatctcgagctaggaagcaggtcttgtcttgtgctcattcataaacatcaatctctagatatattttacatacatattgtctcaaattatctctgaattgcttggtgatgcaggcgtatacggtcgagttggaattagagctaaatcaacttaaagaagagaatgcgaagttaaaactccttgtggtaagtatattgcatatcttccacttgggtaaattatattggcgaaattacattagcgattatcaaattatcccactttataatgaaaaaatatcaaatttttgatttataactaaataattactgaattttaattttaataacattgatgagtttttccaacataaatgagaatagattgcatgagcagttactataatttacactttgtaataaaaaaaatagcaaaattttaattttaaaaaatacataagtggtttttttttgtaataaattaaaagtttaataatatttttattatagtaaaatttagtgactattcatgtaatttattttctaagaatgttggaataatttattagtgatattaaaattaaagtcgactactatttagttatagatcaaaaatttgatatttaagtgtaaaatttggcaactgacaatgtaatttagttttttccgctaaataagaaaacagattatcaattttttgtttatcatgtgctctctagaactaatatgagattatgttttcaaacttaatatatgaaacaggaggaaatcgagcaaaatagaaaggaagaggtaaactttacagccacgtaaaattcggattaattgctaattatataggtacatttataacttggttgtgattataaatttttcaggttttgaggaggaagccattgataatgccaaaaaagaaggtagataaattgaggagcataaggaggacagtgagcttgacatggtgaatgagaaaaagagaaggaaatgataaaaatgcagcttggtatgtcaatattcatatatatatatatatgtcatatataagtgtcacaatatagttagcttaatcaaataagtggggatacaataaatgaattgagtactataatttgtaaactttactgtggttttagaaaataatgtattatcattaatatgatgagtgtgttattctatttcaatgttttgcttctctcgttgtacgtatccagcattttatttccttaaaacagcaaagttaacgctcactcccaagagaataagcaacccaaaaggagcgagtaagaatatgtaaatagagtcttttgtctgtgtgtgtatgtttactactcagtaggtacaaatggaggctgtttactgatcattgaaggtggtcgagctttttgagggaaatttacgcagccatgcatgtggtaaaggttgaagcaatctgccattgtcgatcagagagtaaagagaagctgtagtttttaaactctggctgctgattgatagatggacaagaatgatgacactgcgtggtcatgattaatatatatttacagtcatttctacaaaacttgaggtattatgattcttgaatgcctgtacggagaatgcactgtttcgatggggttttctaaagtttagaagggagtagtgattatattttttttttagcactaaaacattttgagataaaaggaataaacacaatatcacatgcgccattcatctgctgaacaataagtcttactctaagaacccactaggacatactctttcattacccataaagaactctccccatatggtgaaataaagtaactgttaaacccttgtacaataaagggtatgctataaagtaagcatactgaatcataacatccagcgaatataatcttatgaaacgtctcgtcactcacatgacaccccaatagcacatatcttagatcttttaaacgagcaatcaagtgaagaacatcattaacaccaacttgccaatgaattacttctcggtcaggtttagtcttccaagaacctttattcagggagtatgctcagcttgcgttctaaaccagtcggtttttcaagatcacggttgataattctcaataacttagccaaatgcaagaaatcctatcatgttaactggagtgagattggatttgggaagagcaatacatttactatatctatttgttggatttacagatgatctaatcataataataaagctggactgctttttttacaaggcagagtactagaccatttatagaatgaacaatagatgtatgatcgttcttgaaagttaaattaagagttccgtacaacctcaaaatctgggttgtccaaatatacagatgtatctttggtgaagtgattatgggtgaagcatcatggtgagtgacggagaaagatgacaaggggagctcatgataggtgtaaataaaagtagggcttctaatagaattccaagatctccatatagatgtgcatcatactagagttttaattggtagcttttcaaatatttgtactatgttttcaacatattgagatgaatatttattaaattttttttaaaagttataaaattaaaaaattattaatatttaaatatataaaagcgatctttatataaaaaaagttaaattttatcttattgcataagagataacttctaatgttatttctattaggactaattaacactaccctgtataaatgagaaccaaatttgtagtctagcaatagttagtacctacttgtacctcaactctccaagagagcagtaactgccaacaagtatcttgaagagagggaagggggaattgcaaggaaagatttgaattaagtctctttttcaaatgagaaaagaaatgcttagatttgaaacctgcttaaattaagatatgtatttatttttaaattaatttttagatgatatttatatatatatatatatatatatattaatttttttttatatgtattcctttatttagatgtataatttttttattttgattgtatttatttgacacacgagatttaagtttataaataattttataatttttttattaatttattaattaataaattatatttttaattaaatactgaatttaattcaaagaaacagtatattaataataaattaattttttaattaaatattaattattctaaaacgtaatatattaattatatcttaatattataataattaataaattaattttttaatcagacaatgattctaattttaataaataatattttaaatattatatttactaataaattaatattttaattattatataatttctaattctaatatcaattacgttaatagtattagtttatataatatcaaaattaattaataaatattattatggtaatttttatattagtatactaataaaattttaaaatattaaaaagttaaaagaaatttaaaatattcaatttgctgttttttaaaaataagatgaataaatattaataattaaaaatttaattttataattatataataataaccgttatagaatgcatagataaattgctgatttaaattaaattttagtgagagaaaaaaatttaaatatccactatgtatttatagagattagacgcacgtaacgacctttccccccaaaatataagatgaaacacgatgtcaggcttacaaataaacgacgccgtgtctttcacaagcaagtaaaacgcaagacatgatgacgtttgaagaatacacgaagagaatcaataatccatacagatacatagatacacacatacaaacgcttacactacagcaaatccctctctcccgctttttcacatcgcgcaccagaataataatattagtaatagtagtaataataataaataatcgtaatttacatttctcgctccaaaaatttcaaaaggaaaaaaaaattgaaagcaggtttgatctgcgcttgacctcgttgaatctaaggtaattgttatcgctttcttacctatcgcttcaatttcacttcaatttcatgtatttgttgctatttttgctgatcttcacgactcccttttctagggttttctagagcttgtttagttcgtcttttttttttttccttgaaaaaataaattttttgttaatgtatcttaacctccatgattcaagtcaaaattgaagttcgatgttctttttttctactttgtgctatggagtatattgatgtattatggataatttttggaatttttggaattttcattggtcaattttccggttactttgaaagcaatggaacataacatacaaaagtgaagttgtaaatatgttccagagtgatttaaatatgttgtctaactcaaatttatattttcttttattctgccacatagtagtttagagtaattcttccatatctttgcataacctgttcttatatttgtggaatcatttgtaatataaataatagtaggttctgaaaataaccagattctttgacagacctgatttttttttttttaatatttttgtttaagcctatttttgataggtaatcaggtattaacatttaacaaaaagtttaacttttccagagggcatttctaatttttgttttatggacttgggtttctttgagcaggttggctgcttgaaataagagactgagagcataatgttaagttcggggaataataatttaagccgtggaagtgccgcaatatcatcagatcttccaccattgacacaatgcttgcctttggagcaaattacgttaggcaatcagaaatatactcgctgtggagagttaaggagggctttgggtgttcctctaggaagtgcatcagaggattattcttttggagtttcccatcctaagcctcaatccctagcgggtacggaggagctaaaacattttaaagaaagtgttcaagatacttctagaaaggccaggtatgttagcatttctttgcagcagactacatgaatttatggttggccgtgccattagttatttcttgcattcttcttttacacttgaagtttagtgtggaaaagacttggaattttgttgtaagggaagtttgattccaactatgtggcacaactagaggtttatggaagagagagctacttcattttttatttcatcttctgggtcagagaaaatttagtggctgcgcatcctaaaaaatagaataacaaaggataatgattattactttttaattcatgcctttaattcacatgcttagtcctgaaatttctgcattttgtagtacttatagtccatcgaaattctttttgttgcttcatatgttgactgtccatgtttcgcttcagattttgtaactaaagatattttcacaaaacactttcctagctggatgctgatgatatgatgtttttctatcagggatcgagcaaaaatgtggcgtgattccttattcaaattggacaagtatagggaagcgttgagttcaaagaagcgacagaggagcgaacttccgttgaatgagaggtcaaatggagcaactttagcaaagatggggagtcaggttcatagaaacagtcatgatattatggctcaaaggttggaggacagggctaaaaatattgggctgaataagcgggttcgtacatcagtggctgatgtgcgggtttgtacattacatattaatattgtagtctgatatgcgtgtataagttttctgttctgattttttattgcatatatattagccagggtaacatgcagagggtaattgatttcttacttcctggttttctaatctgcttacacagctgtagatttcttttgaataaaatttttaaaattcccttttcccccgctttcatgttgagtatctttaaatagtgatctcaagtagttagtttctttttcttataaaaaataattgcttatgcaatccctccttccatttttgagaggcagaaagggttttgaactgtgactgcctatttgcagaacagctgggccactggttcttgtggctggttcttacatatatttaacatgcatgcatttctttccatttttttttaattttatttcttttctttgatgcaaccaggcagatggtaggtcaaaccttgcctcaagacagcagatggtcatggagaagggtacagatatgctccaagattctggtggaggtactgttcggtttgaagaaaagatccgtagattgcctgctgggggtgaaggatgggatacaaaaaataagaaaaagcgctctattggagttgtgggtagtagaattttaaatggtgatcgagaaataaaacgagctatgcatcctaaaatcagtgctgagtctaagctgcgatcttgcgatactcagggtttcaggtaaagtagtacatccatgtacttgattagtgattttatgtttttggtttggtattgtttctcttacagtccaaataaagctcagaacctgtttataactgccagtataggaagtgtttagtttcgatagaattgttacttgtttccaagactgttatctgtaaatgatatgctagtgtgttggtgttcatattttgtcattgtaagtttattgctgtgataattgtcaaatcattctactctgcaatttttgttgaaagaacaatgctgacaagtacggtgaaggttgtttatttaagcaactttctcttgagacctgccactagcggtgatgacatcttccttgaggttgatgtttgggggaagggggactaagtcattggcctttcagttactccggatgaaactttggttccacggttatgatttatatagtacgtcttagttgattagaaattaattaggaggaaaatactttttcctttgttcttggccgtgtatctctagtttgtcattgccattgctgatcttcataattacgatggatcctctgtcctgttgactcggccattgttatggtactgcttgaaattgttctattttttatgttatgatgggaaaaaaaaaggaacaagtttgttgtgttaatgagtttcttatgtgtcgcaggtcaaaatcttcccctggtgttagtggaatcagtaagttggatggtcctttagaacctactggttcagataccagtacagtgctcaggaatgaaatggatactgtaactcttccaagagaccgattagcactcctagagcagaaggctgtgacaaaaggaagcaataagtatgtattgtccttttgaaactattgtttatcctattaagtggagatgaagagtcaggaaatgatggaaaagctgtaaagtttgaaatcttgttgtatttggtgcactatcttcttttctggacgaatatagtcaggttattaatctgtttgtggtgctatgtatcaggccaaatgttaacgaagacaatttagcaagcagtcctaatacaatgatgaaagcaaaagctcgggcaccacgaactagctccatcatgatgctagactcatcgctcaaagttcagtcctcatctacatctcttcaaggtgcggaactacctgcaagttcaaataaagtaacaatgccttgtatgctaaataatcataagcgtcaaacatctgcaggttcatcttccgtggctcaatgggtaggtcaaaggcctaaaaactcacgcactaggagaacaaatatagttgctcctgtttcaaaccatgttgatgctcagatttcatctcaaggttttgcaaccaatgattttagcactagaacttccactgggacaaatggatctctaattgccaacagtatagataatcacactcctaagttcaagagagaaattgacattgggttatctgaaagtgaggaatcaggtgctggggacaataaaactaaagaaaaaggaataaacagtggcgaggttgctctaacttcatctcagagagctggtcattttcttttgccttctaaaaaaaataagttactcacaaatgaaattggagatggagttcggagacaaggaagaagtggaaggggttcatctttaacaaggccaggcattcacgtagtgagagagaaactagagaatctaccaacaataaagccacttcagagtgtgaatgctgtttctgataaaaataaaaggtgtttatcctcaacactctcctctcccgagtcccaaccaaaatgttgatcaaatcttagtttatatgtcatttggcagtattctgaatatttgaaatatgtttggtttctttgaatcagcaaaactggtcggcccccttccaaaaagttgaaagatcggaagtcttcagctcgcgttgggccgataattaatagtggatctttagattatacaggtaagtgttatttattcaatgaatttgtcgtatcaatttgggttttgcattattaactttttgataatatatgacactgctaggcattgttgtctaagaagggtatttgaaatctctttgctatatttcaattattaggctgtataacagtttttctcttttggaaaaactctatcttgtggtcatgatacagctcttgttgtcacatttcgtaggtgtttagaggtgtgtcagatgttagaatgggctttgattgatatgtgtctattgcatagctgccaatgccctcgcggactattttgtttcctttctcctttcttttttgggttctgatattttgagttccacatatatgcagtgactttaacttggctaaaacctagtagcgtttgtgcaaactctccttgatgttaatcttgccaacatgttttctcatatatgcttttcttttacaggcgaatctgatgatgatcgcgaggaactattttcagctgctaattctgctcggaatgcgagcagtatgaatattgatctctttcttaatttcatctccagataagccatctttgtgttatttcataaactaatacttgtttgctttagtagatcgtgcaagttgtggcccgttttggaagaaaatggaatctatttttgcttctgtaagctcagaggacttgtcctttctaaaggaacaggtacgaggttatatggatagattttaaaattttatcttttctcatgggccagggacttactatttctttttcattgctgttaaatcagcttagttttgctgacgagcttgatgagggtttgtctcagatgcttggtagtgaatgtaacctcttggtaatgcattattattgttttctcccctttttgcaagccttctacatttctatattatgaggataaatgtttcgagttccagtttatgtaattcaagcagactttcaattactaaaatcagtctatctggatctcaagttgactcggacaaatttatcattatttactaatgaaagtttaatgtttctaaagagacataggttaactctgaaattccttctttagggtgttcttgtgcaaaaggaactacctgattattgtggtgaaagacaaggtgatcactctaatcaagattcagttaagaaatctgctctatatggaaaagttgacatgggaagattggaaaagggtgctccattgtaccagagagttctttctgctttaattgaagaagatgaaagtgaagaattttatatccacagtgaagggaagaatatcccacttcactatgctagtgatgattctcattgtggttcatgtaatctgattgatattgaatccaaggatagggataggatggaatctgaagttgagtcaacagtggattttcagactcacaggaattctttcttggacagaatttcatgtgataagagtgttgcatctaacacatttagaaattcaagcatgtcaaactctttacatagcaatggtcagtggccaggagatgatgatttttcccattcagatattgtgcatgccagtgaaatatgttcaaatgatctcagtcagctgcagacaagggacttgaccatatctgccttcccctcctctgatcacaagtatcagctgatgtatcttgatgatagggttctgctggagttgcaaagtattggtctatgtccagagacattggtatgcttcgtcttgcatatggagtgttttatcaagtcatatttggctgcatttactgatgtcatttctgttttcgtatgtttctgttaccttattgcagcctgatctggcagagggggaggaaatgattggtcaagatataatggaactcaaggaaggcctataccagcaggttgcttgccacaaatacattttttgctcaatttgtgtatctggagttattattttcttaaaaagagtttctttgttaataaacttgatttcctttttccctttcaagttgctttggatcttttttgacacctttgattaaccaacagattggaaggaagaaaaggaagttagggagaattgataaggctgttcagaaagggaaagaagtggaaagaaggttagttttctatgatcaggatcatgggatgagttatggatgttaaactgaagaaatatggactggagtaacacgttttgatttgcaggacgattgagcaaattgcaatggaccaacttgtcgagctggctcatagaaaacgactggtattagtaactttcttgttcagctgtttaagtcaaatcctaagggatttatagaatgtagaaatttaattttgttcctgaaaatattagggagcattcaattgggacatatttacattcttggcatacaaaagagatataactatgaactaacctgtatggtctccatcaacatgctagtatagtattatgcatacagaaactttcaaatggagttatgagttgggacttagttgttgacatgttgcgtaagtttaaatgaccatcccttttgcagtcccccctctccttttgcacttgggtgaataaatttcaaagcaacccttttttctttttcaactccacgtcttgataaaaaaaaaaaaaaaactttcatggccataagatctaatctttcatttatggtaagaattttttgagtaaacatgaaaatcatttaaatcattcttggggtcctgcattaaggcaaactgtcggtcctggatcgaaagaaatgtgtaatacatttggatatgttttatcattcatgttggaccttattttcttgtgctcagtagtttgcatgccattaaatcttatgtggattggtccaaaatatgtgcttagaagcaatagagatatcagtgtaaaacatacctcaatgatcatagagaagatagtctgaaattagagaatgtaggaaggatgagaacaaggaaagattttattacttctctaccattactttcatgaaaatcaatggttcaataatgtttaaaaactagggaatttgtgaatttagtggatcctctagaaaaatatggatggtataatccatatggtgaactggcctttttgttaataatggttcattgaattttccacttcattcattttatgcaggcttgccgtcggaacaattcctcaaaaagtgcagtccgcaaggtttcaagacaagttgccctagcttttatcaagcgcactcttgccagatgtagaaaatttgaagatacagggagcagttgctttagtgagcctgcactacaggaggtcatcttctctacacctacatgcaataatgatgccaaatctgttgattgtgtcggctcaggtactgcaagtaacacatgcaatgaagtttctaaccatcatggcgaagccagaggatcaggtataatatttgcattctctatcatgatactttatttgtttaggagatttatctgtaatgtggtgtgcatggttgaatgtctgagttcaggaaacgtaatactttaaaaggactaattaatttatgatagtaatataacttgttgcccttttttgtctgtaactttagaaagaaataccttttcttttccccatttatttcctaaatatccaaagtagatgtgctaagcaacaaaatatgattctttgctgttacagttgccatttccagcacttttgagatagatgattcacatggtgattacttcgatagagggaggaaaagggaagtgcttattgatgacgtgattggcagtgcttcatcaagggttacatcgagtcttgacagtgctgtgcttggtggagtgaagggcaagagaagtgacagagaaagggatataaacaaggatattataagatgtaattctgtttctggaactagtcactcatcattggatggcttgaaaaatgaccgcaaaacaaaatcaaaacccaagcaaaagaataatcatttatcgacatcaggaaatggacctcgtggatctagtcattcagtggctggtcccagcaataaattagacagtgcgggctcaatgtcgcttggggatgcttctaaggaagcagaagaacccattgattatgcaaacttgcagctgcatgaattagacacaattggattagaagtatccaatgagcttggcgggccacaggatcttggttcatggttgaattttgatgatgatgcgttgcaagaccatgattctatgggtcttgcaataccgatggatgacctcacagatttgcagatgcttatgtagaggactattttttacccttttcgtcacggcgggaactcaggaaccacctttgacacctgaatcaacaccaactagtctagctgtggcatgtaaatcaaaagatttgcaagtgtagttgatttttttgtatataatttgaatgtaactggatattcgtatgaaatgaaaaactgcgcttccaatttgtgttttcattttctctcggaattttaggaatctctttgtttctctcattatagccacttgcctactagtagtagcaggatgtgcgtcggtccatggtgtttatggtgtgaggccgactctggtttccagaggttattcgttgatctgtggtgtaatttatcgttactttctcgagttttgatgtcaggctctcacctgtgaaaaccaggaaagtttctgcttactacggtaaaaaaatttaaatctttgtagtgaatgtaaaagaataacaattttttttcattgctgcagttcatagtttataggacctttagtgaattcaagaaaaacaaatacaaattacaaagattttgaagtttctgttaataatataatttcaagtaaaatttgcaaatagtacgtcaccagttcatttagcagggcatgtactttttgttaatacaagtttttattgcactccttgctcatatacctcatattcatcattgtaattggtaatctatcgacttctagagttaggaatttttattctccttttctttgttttttctcgaaaagctgaaaagaacaaaaatcttcatatgtttattgatgtatagtggtcccaaaatccagatcaaaatcattttgtgtacttttctagtctttgccaataatgcttattcaggcattaccttaatcctttctatggctggaccagcattttgcaaaagatttctggctggggacctttgctggagagtgcaattaatgatcatgattgttctgtcctacacttgttttttcttttcattattgccatatgtcttcatggagtagtccttcatgtcttctcataaggaattatgtttactttttcttcttttgttaaacccattaattgaagaaatcttcctacaaaatttctttattcagcattgcaaaagggtctctgcaaaattcagtcatttttacccaagaaggagcaaaaaggagaacctatttatatatatatatatatccttaaaagggtcaaaggttaaatgattaatatatgagaccactaagtaaggactcttgcttgaaatgaagagacacttgcatgaatccatgtatatgaagcaacctgcctgataaatgtgaaagcaaatatattgtgctggcatactcattttccaatttgcaagcaaaaggaccttttatgccctttaaattttcttgatgctatgccgcattcaatcttttgagactgaggtattaagttactaatacaatagctctttaatattaaaagagtaagacttattccaagtgtacaaaacaaatcgataagttatataatatatattttaagtgttttatatttcatcgtttaataattgacatatatatattaatttagtatttatttaaatgataatacacattaaacatttatatattttgtaattatttatatacaaatgcacaatttcttctaaaaattcagagttagagagctataagaatcatctatatataagattaggactttctaaaattaattagaaaaatatttgacaacaaactataataataataataataataatattatcaaaataactgcacagtaagtacacaacttttctggtttaaagataatatatataaaccaatcacaagaatcggatttggttagctatcattggcctttcagcatttcttttatgaaaaatatcaggtgtgctaaagcaatcatgctggtcaatgacaaaatttatcattaaaatatatatatatatattataaaatttgattactaagttccaattaataatttgattgattaaaccgaccattaaattaatctagctagtttgaattaaccaactagtttttatttatctaaatttaaattatttgacaagatcatagtcaaccctatatatattgagatttttttcttatagagtttttctttaaagggtagagatgaaataggatgacaaggcagatcaaattaccgagacattgattcaaaaaccgtaactcgaaatataatagaagatgtctatttaaattctaaaacttcaaaatagttcagaataatgatattaattttgttaaaaaatgattgatttatatttaattaaaaaaatgataataaataacagaaaaaagtagcattagtaatataataataataattgaaaacctaatcctggaaagagacgtatgcattaaagtaaaaaaaagaaaagaaaaggagataaggtcatcttgtattcctctctagctttataatctaatggggttataaaggcacgctgatgatgacaatataatttcaattttcttttttaattccataaagttaatttcgtcttaattaattataattagatattaatttcttgtaacgaacccaacatactgaagacagaatgtaaattacatttagctacaggaggacaccatgattatggcttctccacgtccgtcctttttaattctattttaatgatcaaaagattttctaatttttttaaaataaatattatatatataagtatgagctgcatattgatgtttaattaagtttatggttgcattagtaaccattatttttattttttgtaattttggtgacctactccaatagtttttaagtatttttcctttactttgatcctatgtgtgtccaaatctttaggataattaagctcattttaatactatacactctaatttacaaaattaaaaactcatttagagggttatggtattatagcttttcataagaaaataaataaataaataaatattatttagtaaaatcttattacaagttgaggggtgcatgtacccaatatttttgtatattctcttaaattttgagattaaatcattcttttgacaagcaacccttatgtccaaattaattaaaaattaaggaataaaactggattagtgaattctaattttggttgttctaaaatagagattaaaatggtggatcagtttctgagaattacaaatgatattattttatttttacttataggaggaattgttgaaccggatagatatgaaaacacttatctttatatatgcattgattcaacacaactgcacacatgcacccttctttcctaattttatataaaatcaaaaataaaaatcaccatacacagtcctataataatcacacatctcaatcagactgataatataattaaattcatgttgcaaatataacatataaaaacacaaccagttgcagaccgaaacctatgtcatcacgaagcgaagacacataagtgtttagctaatttatcttctccaccattgatgcattattgttatttactatacttcttttatttcacctctagccaataactaaaataacttaaacaattaaaacagtaaaactatctttaaattagattaatattttagtttaatttcaaaactaaatgattaatattctaactcgtaataccaaaaaaaaaaaaaggatattaataaataaggatttctccatgaatttgtttggcaccaccggtccaataataataataataataataataataataagcacaactactcaaaataaatgtagagagagagagagagcagcagccaacttttgtctctcttcctcaactaaaatttgtactgtatgtaatgtatttaaaaccttttaaagaaacagacaatcaactgagtttatatatatatatatatatatatcctcatcttgtcctatacattaatattacaaatattatagcaattttcattgtctttctcacaaccacttcttattaatgaaactttaccccttatccccactgtagttgtctacaatttaaacattttaactccataaaaacccatccttgatatgtgtgatctttaattctttaccacaaaaagaatatcgtatttatataaaatacccttttgcatcattcaagagtcatcaggaaaagatgtgattgttaaatatgattaatttatgtattatgatcccacaaacttttcttttctttttttcctccattattagctaatcttcattttaagcaaagtggaagcttcctcatgcacatataaaattgatttacatttacaagatgacataaaaatatttaaaatgtgaagatattaataaaggcaaaagagatgaagagaaaagagaaaaaagaaaaaaaaaaaatcctatctcctctaaaagtacctcaaattaagaaaccctataacagcgcatgtatgtcatttacatcaaaatattgattgataaaatacaagaatatatatatatatatatttaaagcacttatgcatgcatgcagctgtgtgttggctttttgtcatcttcatcaaaagtttgtgaaatgattttgagactgttgaaccatttgtagatcagttgtgatttggcatgaattatcatcccccatcatcgacctatacatgaaaaaccatagtaataataataataataattacgttccaaaattgtcatgtgaaaagaatttcagaagaatctgggtatacgtgaaaaggatcttactctctaggacgagatgcccagagggagctaagtgctcgtagccgcccatagtactctccgatcaccagaaaacaccgagccccctgtcttactgttaatatccggcgcagttggtgaagtgtttgctgtctcaaattatcagcctacaaaacacatatatatatgtttccaaatacattaatattaatgtatttctttaaaagaatatatatatatatatatatataatatgtaaaagccgactgatgatatcatcagctggtgataaaattatagcatgcagaagcttgtgatgggtcccaaggtgcaagagcacatgggcaggcataaactcttaacattaattcaaaggggttgaatatcatggagtactactttgtcttttccatagatatatatatatatatatatatggaccatttccaatcatacatcaaatagatatatacaaaggtatatatatatacacttctttcttgatagaatattttaataattaggatgttccttttaatttatttttatagaagtgctgttgataggtgtatgtagctacggtgttttattttcaacaaacatcattttctaaccaccttttgatagcaaccttttcagatgaaaatacaacatcaaaaaccctagcccatcaacattcaaatagacttctcagcaatcatattaagcaatacatattcaccacatgatcaaatcaagatatatatatatatatatatatatatatatatatatatgtgacatgaaaaccctaaattttctttttttctttaaagtaaaaaccaaaagtatttaaatggaccatcaatagtacactaggcaagcaaggaagggagatgaacaaccttggtgtataaaaatcatgtcctttcatgccttcaagttgaccttaaaaaacttgatggtgactacttaaaatatagaatatttttccaaggtcgaaattcgtgagtatagataaatagatggtgggatccatgccaaatacactagacattaaatttaacatattcatcttgttgactaaattaataaaaaaaatatatatatatgtatatatgttatatatataggattgttattttagctagaaagtcaataaaaatgttaaatcaaaattgatgtaaaggaagtgtaagtaatggggctcttacccttcaggtgtaaggtagaattggcggcgcaatatgcgagtttcatagaatatgatgatatagactaagacagaaacatcttatctgccattttagctgttcaagttatttcttcctatacttccaatggtttttaagttggatttttcatattcttgaagggtttaggagtgaatccggtttcaggttttttgacaagatcagagaagagttctcattattgtatctctgactgaaaatgctaatagaataattaataagtaaataaatagaaaaacaagagtcggaccaagaagcttcatgagcttatcatgaaactcattcttctaatgatcattatgttataactagctcaatggggccactttccattgacaggatatgcaaagaacttgtgtaatcaaattatgataagtttatagcaagtaaattaatcaaaagagcaatccaatatttgatgaccttgtaagtttataatcttgataaggaacatacagcagatgccacctagcttaaagcatgaaattttggtaatgtcgtaattcacttgaggaagactgctatatgtcacctaaggacttggctcaacctaattagagagcaggtgacatgctttcaatatatcattatcatggagcaataaaaactttacttgcataagaagtgcaccaaaaataattttcctttcctaagattaaggagtcttgatgcctaataaaaagattttaaagaaatggattgtgactaaaatatgtaaaacatgtatttacctgacgaacgaaaccttcaagattggcaagcttgccaagtgccactgccatttgctgcatgccatcaacgactggcccactggcaatggtgtcaactagagactgctggagctgctctaggccttgggagagagcctcttctgcctgttgtgaggattgttggaggctgtaaatccccataaattgctgttctgttaatgggtccaactgagtcattaacatctggtaaaagaaaaaaaaaggaacaaagacatgagttagaatatacttaatgattaagcagctaaacagggatattttagtcatttgacatcagttgcatgtatgttgctctttttgggccaaaagattttcccttatgatataggaatactttccatagtttaatcctttagcaagataaaaaggggaaagaaaaaaaaaaaaaagaagaagcctgagatggttagtgctgccaatttcactctctttttcatgcccaagaaaggacacccctttagggctttttacttgtctcttcacttttaaatggataatgtgccctttaaagggaagctttaatctcctaagagataccttgcagctcctacaaccctttatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaggtgaaaaacgtcagttttagcagccacccccttcagtcggaaaatctcatcataatgtgaaatgtatctatctactataaccctcaggtcaccatctgataaatgtgcttgcaatcctgtccggaggtctgacatgtgcctatgatcttcctctaaccatcttgcatactccatatcaaatattgcagctcctatatatgtccaaataataataataaataaataaaaacaatgatcgcgatctatagaaaggaattaaggaatgaatatttaatttctagtgaatcacatggtggaccaaaatgtgatacaataaaacattatagtgcattttaaagggcattttacattcctaatttgccttttaaactaaaagaattatatgttttctaaaagtagaaaagcttcattcataccaaatggatcaataattgcctgagattttttaaaaaaataattaaaaaaaaaaaagggttaagatcaaagacaatagctccatgcttggaaaaggccaaattctttatctttaaagaaatttttgaattaaaaaaatcccagaaagattttagtcataaaacttggtcaaattaagaaactcctgccaaatggatcattgagactgtaatatatttccaaattttgactggaaataaaacccaattatttgaaaaacttatattaattttacatgttggtcaatactcaactactcggccaattaaaaactaaaaccatgtttgatcaaaataagaaactatcagagaatattttgtctttggtcttatatggcttattaaatagaagttataatattaggatatataattagtgtttggattaagctaaacgccacttaattatggcacaagactaatcaccaattgccaagtcaggcttttacaaaatgcacctagacaaagattcacacttttcttaaaaaaaaaatgtttctcattaatgaacttttaagcttgactttcagtaaaataatttccagaggactcaccagagcttaaattgccaccggcaccaccacagccacctaagaacagtccctgtaaagcaacccataaaatatatttttttaattaacaaatttggattttctcagaaactacttgaaagaaaataaaaagtgtacatgattttgaaaacctgctggcgggctctttggagatcttgctctaactgggtaagcttgattctactgctttctagctgctgcacataggcctgttttgagataagtaaaagacacattaatgatgggttgttgcattcatttctaacacccacaaatgtaatataaattacatgcaaatataggcataattttatcttactgtatatgtatataatatgttataaatgtgagcgtgtgtctgtaagctacatgtagcattaaattagtcttcaaagttggtagaaaataacccacaccttctttctaaggcggctcttccttgcagcttctctgttttgagctaaacgtctgagtgtctgaaaaaccaacatgaaaaagcaagaaactttgattcccaaaaagttttttcaagaaaaaaacatgaaaagcaagaaactttggtctcactaggaagaaactttggtttttaaaagaaggaaagaaaaaggttaccttagcatcaagctgtttctctgatgtcgaacctttcctctgcaacattgtagaatcaaaatttaaacttttgagacaacatagaaatgcagaactaatttaaaaggaagaaaggaaaatgcaatacttcaaaaatttgaatggtgcaatgacaactggcaagaatggggaagttggttaacttgattaagcaatagaaggctataatcatctgaattttggtgcattttactcagtttggtcataacaactacagcaaggccaagactaaaaaagaaaaaattgaagaatataactacatttttttatgttaataatgtagatttgagaaagcagtgtactttgggaagattctgggactaacaacaaaaaataattattaagaaatctcacagcatttttgggaagcaattctggtaactggtgctgatgtgagtgctgttcttggaaatgacaatcatgaacatgaaatgggtagacaaaatcatcattatctgccatttgtttgtggtcttgggttttcctatggctttccaaaactaatttgtaaggctaaaacatccggctaaactgagagttataagtatcgagtaaagtaggtcattattattgtgaagatacagtgtgttttactactgcgaagattctcactttggcctttggcctttttatttgtacaaccctccctccccgccctctctctctctctctctctctctctctctctctctctctctctctctgattttatgtcagactttgaacagaaaatccttcaggattcagagaaactctgccatctttgattttctgtgggttgttgggatctgtgcttttgtgttttgaagatatgctgagagagagagtgagagagagagagagcacaacagtaaaaaataacaataaagataccagctttttcctcagttttgggatttgtaaagagagagagtaaaaagaagtaggaagctaattataaagaggaactgtagtcaaagaaaagaaccttttcttgtggtgttttggcaggtgatggattcagttctgagggtcctccgcctcctgttcttgaggtatcacttgccatctctagttgttgctgttgctgttgaagctgcagatgcttctgatcaaaaccttgatgatctgaagatgcctttttactaataggagattctggctctagctgggcatcagctttgcttgaaagagtgtttactgctgatcctgaatcagtactctcccctcctgactttgaacttccctggattaattatgcaaaacaaaaggcaaaccccaccataattattcaatttgagtatttcaacaaatgtttcaaagaattaatcaaagtttgcaaacgggcactcaagaaccaccaaaagaaaaaaaaatttaaaaaaaaagtcactttccaatcaaagtaataaagaaaattttcatgaaaactgaaaagtgaagatcatcttaaatttttttcaagctcgtttcttaatttatctagtactcaacatcagaagacaaaacacatagtcaaagcttgagaaagcaagttaagaaactactactcttggtgtgtgttggaatctcattggccatgaagggaacatttccagagtagcagcaggtctgcctgttaccgtaaataaagctgcaagaatcaacaaagcaaaatctcagaggatcaccacaacaaaaataaaagaaactgtatcaagacattttcaaaatcttgccacctaatccccccccctccctctttctttgcagttatattgtgaaggtcagaaaatcatgctaaagagtcagattactatgtttgtagcatcacaccattcaagtctcttgcccaagaatgattactgtattggaaatggtaaccccatctactgtacccctcaatagacatattcaaacctctctctttttctctgctttttaaagagttggttatacttatcaaacgtcacaaaagagatagacaagaaaaaggcatacgtgctttagcttcatcattcctaatcttaactccttgcagaacaatagcttcttctagctctccaaaatcaaaagcagatccttcttgattcctgaaacataaaaaaaagaaaaaaaaaagaaaagaaaaatgaacaaacccatattagtaatctacaaaacatttaaaccaaaagatatcccagaaagattcgaaatttataaacatgaatattcatggttaattacatgtaaccatatgtatattgaatttgcattcttttccggaacaaaattaagaagctggaaattgctaggtatatccatacatgaagtttgtagaagtgttgattccatgaagagcagctgcataagagagatggtgattagaaggacctgagtctgataaacccgtccctccaattccgtggctagccatgcaaagactcgaatatgtttagaccattctcttcatttcttcaataaagaaactgaaaccgaaaaggaatagcagagttggtaaaagaaatgaagacaaaagaaaatagcagaagtactgatatattgctattacttgagcaagaaacagaggaattaagctacagcttgaagaaaatacttccaagaattcatacaagtttacctcagtttggttttgagttgtaaataaagctctaattggagcaaaacccaactcaagaaatagagagaaagagagagagagagtgaaaaagatcaaagctttcttgtcaaagtatatctaagttgctacaagaagggacaagtctttttctcagatatatctctcctttactttgcaactttttgattctttcatgtgtgtctctatctatctctttgctttgctttcctttccttttgcttatggctactactactactactactatgtgaagaaaacaaaccttatttgatttttggtctgttttttccctttatttgctttttgggttatggctttttgttaacctttatctctccaaagtaaatatttatgagtttttgaaactcaacatccttcaatacaatagtacacacacaaacacacacaccaaaatctagtctttgcagggcctgtctcatgccctctgaagaccaagttattacaatttttgttcaacaaaataaaaaatcaaaattatttataatttcttttctattattcatgtataaaagaaaagaaaaaagaggtggggtcttcataaggaacccactagaatcactgactcctactccactcttctctctcctctaaccgcctgttctttctcattggtccttttgatggggctcttcaggatttcaagtacttgcagaagcaaaaggataaaattttattaaatatcctcaaataaattcaaacattgaatattattgatatgagacaagtttttctttcagaaaaagatggtaaaaaggaagaaaatttaaagaaaagttccaaaggttgttttcattttttgatatcttctttcttttttttttcctttttttaatgtatatgcctcccaattccaaaggaagaattgagtttacttttgccaactcaaagccaagagaaaataaagaaagatacaatcttttttgttaaaaattattttgtgaaatattcttttagagttttgctataatacccatttcaaccaaaagattagaataatgatcccccaagcaaaacccacttgcacatattaatccaatgtagttccaaaatacaaaacacaaacaaattcatatattaatccaacttcttgagatggatttgtttggtattatcccctttgttgatgggtcaacatctattccctgtcatcacctaaaaccatgccacattaagattccctttcctttaatagaaatagaaaattgtgttcctctaagcctttaattctctaattaagcttttaatttaggtaaggctttcttattgtcaatgcctgccccccaaaaattttatcttttgggctatatatatacaaccatcctttaaaaataaactgcccttcaattatgtaaagtctattacccaaaaggaaaaaaaaaaaaaacccattaaaaagttaagagtcaatatacattaaaaatagttaagggtttagatagctatgagcagcaacagcattattaatgatttaaaaaatatgtttgtttatatacccatgacctcttttctttcacagaagaggtggaagaaaatattttatgttgtgctcatctacttccttttgtaggtaatatgcacttctaccagttattccttttagaacaccaatgattggcctaaaagaaaaaaaaaatggaaaataaataaatatatatgttaagctcaaagagagaagaagtagcattcatggattaggtaaaataggtatttgaattattttttttaaaatccttatataccttttgttcccaataaaccttacaacatgttcttcacaaggaagaatatgatgagtcttctcttttctttttagattgtagattccataattaagtcttgcaatctcacacaactgttttagttctttttaattcttatttgattgcttgtatgcttgtagaaaggtgattggtctagatcaaatccaagtctgaaattatacctctacaagtttttgaaaatttttgtataaacctagaataagactattgcttgtcacttaagcataaaaatggaaaatcaaatacatttatatatatatatatatatattcttgcttgctcttataaagtattgggttaaactatgccaacttgcaacttattctagtttatatcattactgcagttgcgtgaactaagtttgcaagattgtcccctgcctgcaactttctcattattgacttaatccacaaagtttaacaggagatcaagaagaaagaagtgggaatgtcaggaagagaagctgcccctaatagacattgttttgaccttccactgacaagagaaaaaataaatatacctgccaatgattactagtgggactcaaaccacatgcacaatcggaaagtcatgattgatttataattattctcaatcaaaattcttgtttaaaacatgggtgctaaaaccccacttctgcttctctccccaccatttttattcatttatcaaattatactcctactccatttttcacaaagtttcctgcattattccttaccagaaatataattgaaccctaaattagcaacttgtttgcccattttaaaacacctttgaagcaaccaaaacggcttatgatggtccccttttcaaatttgcataatggaaattgtaacaaaaccataatgcataacacgaattctaaaataccctcattcattaagcatagtctcgactaagatccaattgagtcgagacattccatgagttatttagaactgattcaaaatacatttgagattaacttgatcaacatccgatcagactcgagctccaggagtagcttgatgagttaatactcaacttgacaaatttatgagtttagtcctatattactattttagcttgatatcctaataagccaagattaagcttaaaatacgaaatttaatatcaagtttcagttctaattattttatcattttttcagaaagattaaggcgaaccaaatcaaactcgataaattgaatataccattgaattgcgcttgaactcaaaaattgaaagcttgatggaatttttagatgtagtcgaactccagcctgacagggtctcacttacaaccctagccttggcatctcaaggcttaacttttataagtcaacaaccaataatgatcataaactgcatagatcccggattttgaatctctttgtggtatataaatggaaacataattgaaatttggcacacatttggttgttagaattggtaaaatattttccaaaagccagctatacaatggagtaggtgttggccattttaattgcctgcacaaaatgtgcatgcattcagttatatttttctgtcctattcagggttaaaaagttgactttcttcattcatggagtgctagaacacagaatttggtcaattctgcaaaagtctaatgcaggaatttatgatttttttcaactttctttcggacggcacatgtagccaaaagcttgtaactgaagagatcttgtgttccattccagcattagaaaccaaagcagaagaaaaatattatagttgacatttacagaacaagaacctccaggtaagagaggggaaaaacaaagaattactaaaagagatcaaatgggttaatcatgtatcctgttaaatatgtgttttgtgtatgtgtttcctgtcaaagttcctgctggtcagtgttttcattctgacattaacctcttcagagtggctgggtaactccttccatgcaattgtcagcccatcaggcaggcccataatttcttttggaaggatctcaaaaactgaattgagattacatcctctaacagaaaactatcctagataatctcttctatagattcagggccgatttagggcttggccagttctgtcccagatagactaacagaaaaccaagcactagtccactaattagtttaatttgcactaaacttgattaagtttttttttagtataattttatgttcatatcctatatttaagtttattatgttttatatagtaagagataatattatattagtcaagtttcatttaaattattataatttttaacataaactaaataattaataaaagaaaatatgttaaatattttcctattaatatttatttgtatctcaaacacaaacattataactattgaagtatagaagcatatgattaaaaaaagaaaattttaatgcagttgaaagaaacaatatcagctgagaatgtgagtggcaattcaaaaagaaagactttctataattgaaagaaaaaaaaaatgaaaaatgcaatgtagattgtactaaatatccaattaaaacaagtgcaagcatccttaagatgcagttttccctctttaaaggacgttaagataacatggcattataaatccaaccaagtaaaaagatttgtacaaacagaacaaggtcaccgatatttcctttaataatctttcaaagctaacaagaagcttatgacaattgacaaatacatgggaaacttagtttaccaaacagggaaaaactatatatatatttggcctttttctacttcacaggacactaagatacagcaaattaagataggctcatttctcacataacactctgctgaccaagtggattggaccctaattaagaaattcagttttgagttcttttcacttcgatgttccccttatttgatcgcagtgtaaacaaggctgcttccaatagttacaataggtaaacagggaaatgatcatccaagatgttatgaaaagaccaaatgaattttaaacttgaatgatacaatacaagtactccaaagtaacaattattatatgcaactagagaaacaaagctcaggtaatgctagatgaggaactaaaaatggtgcaacaagacataaaatgcataatgaagtacaaaaccgctctcggtgcctacacccctggaggaaacctacataccacatttacacaatataacctccttttttccatcaaaaggtcacataaacagagccgtggattactattatggctttaaaaaacaataaaagatatagataaaaaaacattagatacacctaacacattaacaaagacttgatgaaagagtatgtatcaaacaattaaaaaaagactttccatgatgcaaggttaacagacctcaattgttattaagcaaacaaatctttgtattccctcacatgaacatctgtgttgatcaaaggcaagccaatacttgaaagggacacaggaaaccaagtcaatgaaaaccatactacgattgtctgcatatcgacaaggaaacattggtagaatgagaataagatgaatttttttgctgaagcaacaaaaacttttcattaaggaaaaaaagaaaccaatggtcatttacagggcatggaaagaatactcaggctctaaaaggtgtaaattttacctgagtatctgctaatacaactaccatttgaagagtctcgaataatgaccaaataagcacgaactattcatactgaaactgcacatctacattcgtgtatttcctcatgagctgaactatggatgaggtgaaattagccaacatctggcattcttcttggctttttgcctctgaaacaactccatagattaccaatttcctgagatttggacaacgttttagcagcccttcaacccaatgcgagaagagatcattaattacagtccatccaagctccaaaacaaccacattcaccaagtttgaagatccttgcaaaccatactgaagcaccccatctcttaagtcataacttaatgacaggtggctaagctgtggaaaataaacagcaattgtttccaaatccacaataccatcatcgtcatcaaagaccacgtcccaaagacgaagtcttcttaactttgaagattttgagatcagctggtagaactttggccagataattgtaaagttgctaacatctacaatctcaagattatcaactgtctcaccaatatcaagatgtataacactaacatcatcaatcttgaaatgcttcaaatttcccttcccaatgagttcaaatagctcaagagcacaatcctttaagtgcaaacattcaatactatctgcctccaaaataaatttgtccaaactaattgcttcaacataaacactcttcaatgtaggactgctgagttcgatggttacctgtgcatcagacattgcaatctctggattgataagttccaacaactcaatcttcggacatgcagtgagcaacagactgagatccagtgccgaaatactgacataactcagagaaagggatttcaaacaagggaatctctggaaattgggttcaacccctgtgatggagttatgcgacaattccaatgtttccagtttctgtctcccacaaatctcaagaatgttaacattaggtgtagtccgaacattatagaacaaccgccgtagagtttctctggtgtacataagccaagcaataactgttgaagctgagaactcctcaacgtcatccatcaaaatagtcaagccttgcaacccagttgtttgaaatatagtttgagttatcaatatttccagtcgactagttgtcagatcatgatacacaggccaatcattagaattgaatgaaagtgtgtgaaggtgtctgcggcaggcttctcgccacttccgacatgttgcagatgctatcacaacatcccgggcacctcctaaatgagataatatattaccaatgacttcaactggaaggtgttccattacttcaaatctgaaactatggtttcttcaaaacatatcaagaaaactaaggtgctctgtttaaaatgatcgaacccttcaaatttttaatatctatatccagcatatgcagcttgttggcagctacgacataagtttgctccaatctgtaaattttagagctgcttaatacagaggaatagctaattggcagtcaggcactggtcaaaaattgaagaaatctcaagcattttgaaaggagggaggataggctgaaatttgaatacgttctagattttagtatggcatactgccattacaagacaaaagtatttgatcacttcaggaggattgtgtcttcaagagcaaggaaaaatttttcttcagtgtgttttaagaatctataatacatctaaaatacaataactactagttacctaaaaattgcaactatttaggaactgaaaccttaatctaaacagcacatcattataagctggacataaatgacaaggagaacatcaaataagaaaaaatgtgcaaaccccgttagaattagacaccgagaaacccactacaaactcaaagatcaagatctatgaattaacaaattgcattaatacaaatcaggacagcaaatgcatgacaacccaagccaccaatttactcaacaatgtcaaaacgaatagtgaactaaacaattagatgcaatcaaattaacaaaagggtctcaaagatctaaacaaatatagcaaaaagaaaaaagaaaagagagattttgatagaagaacactgagtcaagaagagaccttttttctgcccagaacataaaatcaatagacagagatcagccagcctggcgagagtgggagagatggtggtcacaacaaagaagaatccatttagtgggaattaatgaagatgggttttatggtattggagaatgttgatcgttgtttgttcgtattgtcttcgagtatttaaaaagaggcagccagcccttgtaatctatccatgaacaagccatctttctttgtttggcaagtggatcagtctattcttgcttttgccttgcagaaaagttttgtaatttatatttttattcttttcgttctttttttttggatcaaattttcatttttcattgttgtacgaaatattgaaaacataaattccatcgtctattagataaattccatatccaaataaatatcttaatttaaaaaaatgcttacaaccttttagtcaatatatataaagtttaattatatttaaatatatactaattgttatccgtacatatagccgttattgttattttaattataaaatataattaataaatataatttaataaaaaattatatttaatattaatttataatacattaaaaaataacaacagactaactatttttaaatattttattattattttctaaaattaaaattattatttaattaaaaatttaatttattaattaatataatattaaaatataattaactattatttctaaagattacagtcagcatttaattataaatgtaacttattaaataataaattaataaaaattataaaattatatataaaattaaattttatatataaaaaataaatataaatattaaaataaaaattttatatattaagatttaaacaagcacatagaaaaaaattagatttcatatatatatatatatatatatatatatatatatatatataacatacatatcatacgcacatatatatttacattatactatacgtgagtattaacaaattttatttcctatggtataaatatatttaaatttatcaaccttaattttattttatctatatttaagagggataattaattattagaaaacctttaggctaataaaaaattaataatatttactaaaaaatttgagtgatagcagtgtatgctctctttcaaagcttgatatttataattattactcaaaaatttaatatttttaatttttaaaatcttaagatcttattaatgtaataatataaaaattatttattaattttaatattatataacttaatactgtaattaatattactatttttagaattaaaattttagtatataattaagaattcatttattattaaatattatattaaaaatatgatttaaaatgttatctttttagagttattatctaattaaaaaactaatttaacagttattatactatttcttagaataaaattagctatctaattataaaattatttattacttaatataatactaaaatataattaatatattattttttatgatagaattaatgtattattatatgattagaaaattatttatttttttgataaatttaaaaaattatttattagttaatacaatattaaaatataacaaatatgctatttcttaaaattaaagttagttttgattaggaatgtaacttattaatcaataaattaacagaaaaaactataaaattatgtattaacttgaattatacgtggcaaaaatagtgtcaaaaaattttaaatcttaaaaattaatatatatatatatatatatatatatatgtgtttactaaaatcatttttagagagggggagttttaattaaatcttacttaaaagacgattgcttgaactttgataaaaaaaaatgtgcatattaacattcaaatacttattaattcttttaacaactttacctttaaataaaaggtaaatacattaaaaatttctaacataatttactgtgagcagtgatattttgttataataggataaatattaatattaactaaaattacagaaatattttcttttaacagttataagggagggaaaatatatggagaaattatagatagttgtctttgattttactctttatcttgtaaattctaataaattgtggtacgtagttgagaatcccacaatgaaaattgcttagctccaggtcaggaataatacggtgacgtttaactgattcaatatgccaaacggcttgtcgttgggaagtctacctgcagcttccagttcagagaccagaaaaatgggaacaacacgtttgactatattcaatctttctctacatgtaagctcttctgagcaagttttttttttatgattcgattgacaagaaatgggaagtatttcaatctttctctttacaactgtattcctctctctgcgatcagccacctcatcgccggccaatcaccggtacaatgtaggagatcacgtccctctctttgttaacaaagtgggtcctttgcacaatcctaggtaggctcagtaaaagttgtatctttattgtttataaagcgcaaagttttaatctgttctttttaattctgtcgtgcagtgagacatatccatattataatttcccattctgttgcccaggttagaggctattgcttaatcttttgaccccagaaattggaactgaggtaactttgtgtttaatagcatttttatatgggttctgcagataatgtaattttaaagaaagaaactcttggtgaagtgttgaatggtgatcgtctaagtagtactttgtatgaagcaaatttcagggaggataaaactggggtgaccctttgtaagaagaagcttaaaagagatgaagttttgaggtttagagatgctattgtgaatgacttttacttccaaatgtattacgatgatctcccattatggggttttattggtaaagttgaagagcagagttgggttgttggtgagaggaagtttaggtattatctgtttaaacatttgcagtttgatgttctttataatggcgatagagtcattgaagtaagtgctttcagtgatcctaatcatgctgtcgatattagcgaagatgctgacttagatgttgagttcacttattcagttctctggaatgcaacctcagcttcatatgggactaggatggttagatattcaagggcttcattacttccaatacaccagcagattcattggttctcctttgttaattcgattgtcatcattttgctcttgatgggattgcttattgggctctttatgcggcgtctccggaatgatttgagaaagtagtgtaatgttgaatgcttcactcttagctgaatttaatttggtcaggcacagaaatttccttttctttttttttttttggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaagataaagaggttggatggaaatatattcatggtgatgttttcagataccctcaagacatgtccttgttttctgctgtcttgggcgtgggtacccaactgctgacagtgtaagtgttcatgggaaatcaaattttcaacctactatagatattttctgatcctagcttttattatttgaagtagctttttgggatccatatttttattagatagtagtccattagctattctttagattgcacaagtgtaaagtttgtattctgaaggaacaccgtatcaggttttgccctattatgtgctcacttgcctggttgctaacaaatttgtgaagcaacactatgcaagagacaccaagatcaattctttgtctctatattctttttcatttcacaaaatcttcaattttcccattctttcctgcctggcagacctgaattcttgaaatttggctttattcaagagttcatctggtgtttctttatatcattctcctagcatttttaccattttttcatacattggaaaggatttgccatattgtttaaggtatctgaaaatatagtttgaaattgggcagtaaggtgactgactagaatacaaaattgcctaattagaatcctgatggaatcaatcttcagtgtgttttactatgcatctaagagccaagatagtagacatggtagaatacatcaatatgtaaaatgctacacatcagagttctgactgtatactccaaattgcaatttttgttcagggtttgctttttatttgtactcgcatttattggtgtcctctatccttacaaccgtggagctttatgcaattcttttgtcttcgtttattctcttacatctgtggttggggggtacaccgcatcatctttccacaataagtttgctgaaactggatgggtgaggattcttttgttagtatttatttcattcttttttatttttatttatttatttattttgcatatttactggaataaacaatgatctctatttcagaaaaggggtgttcttctgactgggattctgtacctgggtcctttgtttgtgatactttccattttgaatattatcgccatgtcatatggggccacagctgcaattccgtttggaaccattgtggtgattcttctcatacacatatttttaactgctccgttgcttgcctttggaggcgtgattgggtaccacttcaggtctgaatttcaagcaccttctacaacaaaaagattcccaagggagataccaccattaggatggtatagaaaaacaccttgtcaaatatttcttgcgggtcttttatcttgtagtgcggttgtcctcgagttacaccacttatatgcaagcttgtggggctataaaatatgcacgttgcccagcattttgtttgtcactttcatcatacttatcttacttactgcaatcttgagtgttgggatgacgtacattcagctttctgcagaagaccatcaatggtggtggaggtatgtcctcttgcaaagttcttgcatgtgcaatacacttgcatgtcttctggttttaggacgtgttgtgcatattgtgttctagttgcttataaaataaggatcattaaacttgttgatggatttttggatcatattttcactaagtcatcagtttattattcaaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagttgatgtttctctgtctgacgggggaactgtgatgggatttatatttgaatttaaaaaagaaggaagcatggtggcttgggctattctatttttgtaaaaagcttgtcttaagcaataaaaggagttcattctttccttttctccctttcactatatactgtatgttcatcacttgtttttctttccgatgcagatctgtgttgtgtgggggctcaccggccatttttatgtttggttattctatcttcttcttggccagatcaagcatgagcggcttcttgcagctatcattcttcattgggtataatgcttgcatgtgctatgcattcttcttgatgcttggtacaattagtttctgtgcttccttcatgtttgtttcgcgcatttaccatgctgttaagagtgaatgagtgtccgtcctttctgctcggtccttgtgtggtaaactcttcctcaaaggttgaagaagggagagagagagagagagagagagagagagagaggaggagcaaagatttagttattcttgttgtaacatccattaatttttttctgcgtggaaggatacaatgaccaaggtatagaacagcaagagaggaaatcacgtgtctgtagctttggaagatcattaatatttaagacaacttgaatgatattcaaatagattatccattccttgttgacagtcaaaatgcacaaagacatgcaagattattcattgcttgttgacagtcctacaggatggctgagtgcacatataaatgcatgtctatcaacctttgtgagattaaaaagaaatactatttgtaggcaagataaaagatataagcatcatatgttcttaaaatggcgcataaacagaatgcctaaatctgttgccactgttcttcttaatacaggtggtggtggtgggttatctttcataattttcgtattacttatatattctttgacttaccatgcaagcggtcagagtattccaactgagttgaatgcgattctgagataaaatatttattagttgtcaacagccatgtttgatatattagtgataaaatgaaaacaaacaaagcatccacttacaataatatccatcattcttataactggttgttagaccattaaagaatgaaaggcagcatttctgaagatctcctctataattcttttacttggaaataatgcatgcgggaaatgactacttctgttcgtctcttggaaattaaagaaaataatgcaaaacgcagttgagcaatgaccaagaaaaaggtgtttttccagtatcagatgttgggtacacaaacgtgcaaaggcataatccttttcttttctttttttttgaagtcttaaaattatgatcgccacttccacttgggcttttgtctggctgcaacaaacaactctaccgaaatattagccaagattttggcaagcacttttttcggttgagaagttgatatttgaaagtccttggagaatgccaagcttcgtcaactagccaataaccagctttcatgttagttacagctacattacattgtctgccaattactacatatactttcttgtattcttgggactccaatctcatcccaaaccgctttgagctttactcggttacttgaggcacttgctggtactttactttaaacatccatttcttctcaatttgatcctttaattgttgagtttatagttcattattggtttttgggtttatgcttaaagttttatgtcaactttctttctttttctttttcttttttccctattcgatgcagtaattaatggtttttaatatcattctttttctggttttcttgtcctttttctgggttctttttcctatggtcttttccctgaagaataagaatgatcgttgtactcatgcattacttttttaagaatgatcgaatgtactcgtgcattactttcaagtagcaataccggaaaacgcttggacttaaatcgtttcaggggttttcatctttgacaatcaattagtttaattgctataaatgttatttattaaccacgtagagtggcatttgttctgtgtatcttattggtttatcttctgcaaatgatgatcaggttcaggaagaactagagatggcagacctataaaacttatgcagctttggtttctaaatcacctcccttctgctcaattatatagtttgaaagagttgtaatttcgccttatccaatggcaacttgcatttctcctcatttttgtgtgccagttgatcttcaaatattgtttggggaaagaatttcaaaagcaactcaaaccagtagattaatttcctcaaagatttcttacaagaagagtggtgcatgccatgcatgccaaaagactggtttaagttttcctcaaattaagtgttcaattaactctcataacgtcagcccaaataacagcaaagacaccttctcggatttacatcctgaggtttcaatgctcagaggcaaggaagatgacttatactctggttggagaaaagagagatctgaaggaaataccactagggaatctagagattcctctatttcaagaaattctgacgaggctaagatcaaggttattggtgtaggaggtggtggctctaatgctgtaaatagaatgattgagagttctatgacaggggtggagttttgggttgtaaacactgatattcaagcaatgaagacatccctcgtgttcccagagaaccgtttacaaattggcaaggaactcactagaggtcttggtgctggtggtaaaccagatgtagggaagaatgctgccaatgaaagcaaacttgcaatagaggaggcactttctggtgcggatatggtctttgtgacggtaggacaaagctttgtctcgtatgaagtccaacattaatgctatgattaaggttatgtgattattactatttccttgtcatcttattacatctgactgatgtaggctggaatgggcggaggaactggtactggtggggctcctgtggtcgctggcatttcaaagtccttgggactcttgactgtgggtattgtcaccacaccattctcttttgagggccgaaagcgtactattcaagctcaagaaggaattgcagctttgagaaacaatgtggacacattgattgttatccctaacgacaagttgctcgctgctgtttcaccctccaccccagtgacagaggcatttaacttggctgacgacatacttagacaaggtgttcgtggtatctctgatatcataacggtactggtttcaagaaagttgttgagccaaatattattgttctctcttatgtttgtgttttcattataggttctattaccttgcggttatttcttagttgcagatatctttttgtgctacatacttgtgtaaactagctcgtaactggtgcaaattccatcaaattcaaagtatgtactaattttatgcctggtcaagtccataagcttcaatcaccatactccaagttcggttaaaagcatgccatccactctaggattaggggactagtaaggaaagagattacctttgctgtggtctaacctgaaaagtttcactttctgcctgtcatattttctacatgaggccccgtctgattcgaggagactaacttgtttatggaaatgttttctggagaaaacttttttcatgaaaatgactatctgttgtttgattacaatatggaaaatcagttggaaaattttcttgaactgcagatccctggtttggtcaatgttgattttgctgatgttcaagctatcatgaaagactcgggatcttcccttatgggaataggaactgcaactggtaagtttgaaggtctaaatatggagaaaggtctttcttgtcaatcttacaggtggtatttagttttggcaattaagaattcttattgtactaggccattgcacaacgtcaggcatgtatttatttttttgaggacatctgacaactgatctaatagaggtagtgccaattctgaactaattcagttttctagtctccatttctgcatactgtattcacattccatgtcactgtagtcatgtttttttacaagtttaagagttgcttatggtcccaatttatgctcaagatttccgtctcacaatgcaatgcttcagtttcattccattcctgtcattttcactctctaacttattgtttagcgtctattcttgatgtacatggaatgatagctttagttgttgattagcagggaagagcagggcaagagatgcagcattgaatgctatacaatcacctttactagacattggcatcgaaagggctactggtgttgtgtggaatataactggtggaagtgatcttaaactgtttgaggtaggtctgtcaggtatagtaccaagttcaaattgaagcccatagttatggtgtctgcatgtatattgcattgtgcttgttttgtagaagtttaaggggaaaaagaagaacatcaactccactggaatctagaataaattttctggaagttgaaatgattttacaaattaggaagcagatggactaaaatttcagaacaatttattctgattagtactcttgacttcagttcttatgaaaagctttttacaggtaaacactgccgctgaggttatttacgacctcgtggatccaagtgcaaacttgatatttggagcagttatcgaccaatcactaagcggtcaagtaagttggtggaagaaagaaacattacaagcatattctttccctgtaaaaaatcagctcaaccaatcagtagttctgcaacttagtctgatgagtgaaaaaccggcatgctaatggaatacttgattgttgagttccttgttcagtccttgtcaactctcaataatgtgatattctctgctggaaaaataaggattgataaagactagagaaattgagatttcagtgagacaactttaaatggcaaacccagcatgtgaaattgttaactcggacagtgatccatgttctttccgtaaattgcgacagctgctgcattagtaaagaggactactgattttgcagtttgaccatttacttttctttacgtcttttatatgatgtttcgtagacaattacatccggcgtgttgtgtctttttcaggtgagcataaccctgattgctaccggattcaaccgccgggacgaaagtgatgggaaggtaagacttctccatccattcttcttttttcttctgttaaatttttatttttgcttgcctgtatccttttgatctggaaaaatgcaggattctcaacatgcttgtagtgatgcttctgttggaatgaggagacatgcttcatatggtagtggcagcaggactctggagatccccaagttccttaggaaggaaagaaaaggagttctatcttctcaggaatctaaccatcttcattttcttgattatttttgttagaaatgtaaatatatattaatgcctcttcttcattcttttttcccctctattattatcacctcttctgaatcaaattattggaggaagatataaatcttcatgtttagtttcattctaaggcctaaaaaatatttgcaaaagaaacaattatatctcttgattttattttattttttcgtttcttttttatatttttttctataaaattattcactcgctttaatttatttttaacataatatttatcttatttaaaataacttttatagttattatttaatatattagcaaatggtgtggataaacttttaaaattttgattaaaatgcaactaaatccttaaactttaaagtagctcgattacagttttaaaatttaaaaaatataataattatatctctcaaactaactttttttttttaattaatgatgatggtgttgatttttttataaaaataaaagataaattattattttatatttttttacctattaaaaggccaagctactatttcctcggatgaaaaaaaataatatgcattgaaaaaagctaaaacggcttcttttaatatctaaattaactaaatcattatagactgaaatagatgaaattagttttaagaatgtaattattctgtttttaaaatcttagaattgtaattgagcttttaaagtttaagagcttaattagtttgatcgaaaaatcaagtgtttatttatcattttttacctaatatatctttattagcaaataaattctgaatatgattcatttgcaaatagaatgaatttttctaataggtataaattaaatacataataagttattttgaattaatttatgagcgggtcatgagattgtgagctcgaattctattttgagcacataaaaaatattatttaggtgtaaaaaagaaagttgtatagggatatatattttcatctactccataaagttattaattcaattcaatttattttgtaattgtagtcaaaatgagcaaaactactcacgtcaatttataatttaagttgcattcatgaatcacagtcatcaaaattaggtctccgtatggtccacagttcctgccacatggaacttgcccaaaggacagttaattaaccggtttcaattaattttatttttaaaaaaaaaattaacgtaagaagaaaaccgatttgaaccgattcttctatgacttttaaacccgattccaatccgattttaatttgtccagttccagggtcaggccgagtcaaatgagctaagctattaattgagatttgtaatttaggtttctgtcataaagacagacatcaaatgttcagaaaaatgcattaagaaaatcaagaagaagaagaacatgggccatgacgaacccgaaaacttggtggcggaaggcaagtttcaaaacgccatagcctaccaagctttgacaataaaaaattaaaatctataattataaatgttaacatggttaatttttttaataacaataatcatataattaacttactggaacagattacaaggagttctttgtcatgtgcgcctgaatagttgaaggcttaaggttttacctgctgcagatgccaattcccaaccacttcatataagaatttaatagaaacgtactaataattaataataattccttggctcttatgcaaccaagaaaaaatatcccattttgttgcttgcaattgcatgtccacattccctaagttgcgcccccaccaaatcaaatccactaatcctattggttttggaccaacctaaatcacccttcccttgagtttcttttttacttgcttaaatcaattttacatttactgtcaattggtgttagtgatggtgcggttttttggtatcgacggtggggacggctttaattctgagattattgtttattattctgtggcgatgatggagatttctgtgaatatcttcagcgattgtgcatattttatttttcaaattgatagatgatggagataatagaatggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagccgatggttggattaataaatctgcaattgctgtgttttctggtgacaatgttagtgttaatcctaaaacaaaactaaattgaatttgttaaaaacacttaattcttttatacataattatatgggtcctaaagaaattatatttcaaatatatctagaggaattattaaacttctcttagtgtaaaaattttgatgtatatataaatttcttataaagattagatgggtatttaaaattgtaaataattgttagatccatagaacgaagaacaatcactttaaatgtataaattataattttttaaattttaaaagtgacgaaagaattattttttcaataaaaatcacttatatataaaaaaggtagaaaagaaaaagaagaaattaaaatgaaattaatccatgttataaaatctatattgatgagaaataaaccacacaaacaaaaatgaaaatgagaatgacttcaatcacaagcacacaagacgtagagatgtcaggtaccatacattataatctcgcgtgacgtgttttattactttcctttcctttcttcttcttcttcttcttatattatatcctattcctcacaaaacccttattattcccttgcctccactgcaaaagtcatggattccagcacccttttctctcccaagaaacaagaatccacatcctcaaccagcaaaccttcatctcgccggattctttctcccgcgaaaacaaactcgggtacttctagggttattgagaagttgtcatctgaactactgcagactcaagaatcgcttctaggtacctcatttccatcatattctcctagacaacatgttaatgatggtaacagtaatagcaataataaggaagacaaggagggtgcgtggacgcataataaggataacggaagagaaaggctgaagaggcatagggaagaggtggcaggagaagtgaggataccagataaatggagtcaagagagtttacttagagattggatggattactcttcttttgataagttgctggcacctaaaggactttccttagctcgtgaagcattgatagctgaagcacatagaggtggaagcagctcctctcagagattgaggataggcagcaggtgtttttgatgaattaatttttcttttcttttttttcattttttatagatcgatgtagctagactgttcgtgtaatcatcattaatccctgtatgaaatctcgagttttcagcggtcatggttgcaaataaataaaaatcgatgcatgcgagccttcaatatcattgtgtgttttgttggttaagttctatgcattttatcgtgtaattcgtctgtacagtaaaattattatgcattttccattagaactactaagatggagaattgatgtgataatcatttgtgggagtgatcaactagaggccatagatttagatccatggatataattaaggtactctctttgcccgatcatagctcatgaaacaaaatagaaaactaaaatgggattttcaaatttataaatgataaaatttaaaacatatcgatatttttagcagaataaaatattcatattattaatacgataattatatcatacactaaaagaattttcaaaaataattatcaatatattgtatttgtaacccaaattggaatttatagtttttaggataaaatccatatctagctagtagtactggtggaagtattaaaataaggaaaatggatttcaagaagaatttaagaaatggttagtacaaatgttaaattctcactaacctcccaataaaatagaaaatatttatattattccagagtatagataaaatggtaaagtttctttatactttatactttaccatccatgaagattttgcctcatatatttaaatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggtggcagaaatcacatatatataatgtcttataaaagaacaatacgaactatacgtaaaaattaaaaaggtgctaaaccagaagtatgtgttcccttctaatctgatgatgctcaaatggttgttcaagctgtcgacgacaagagtctctaacttttggcttaattattgttgattgtaaatctctgtcaaaagagataaatgatgtgcaatttggatatgttaaaaggtctgcgatttatgcagcatatgaattggttcgtgctgctcattctatggcagatcttcaagtggggagtctgcatccccacctgtgttactgttgacattttgctctctgatctttttattattcaacaatagtctttcttttctttaaagaaaaaaaaaaaagaaataacacttggagagaaattttaagggaaaggaaaaaatatataaataaaattaagcaatccacatgtggaaactaagtcaaaaactatgccacgtacatagaccataaactaagcatactttatctagttatatagttttataattttgttatgtgccccaacttatgcaaggtgatgttctggtttatttatgttcatgtctgcaaattattaaatatgtttatttatatccatctcttaacaactgggtgtaagaatgttgccagcataacccttgaaatcacccgacaggacaaatagtttataggtccaatgtattaaaaataagagaaatatcttcttcttctccttctccttcttcctcttttttctggaaatataagatcattttcatgggtggatggatagcttgagctgccacacaaggggcttggagctttttatgttcttcattcaacattgttaaacaataagaaatgcaatttcaagtgataattgagtctcaaagtcaaactacagttatacttgaaatgaggtgttaaacatcttacttcataattatatttaagagagagtgttagatatttcacataattaaataataaaaaatacaagtaatctataaggattatagtccaaccaatcaatcaaattgctaattctaattatttttatattgattggatctaaatccaattttattagttggattttacggttcatctattcatttaaatcaaatattaaaaatcttaaaaaaattctataaattttttttcatgcttttttaataataaaaattagtttatttattattaaaaattaaattttgatacatatatattaccttttttaataataaataaattaattttaaagctttaccggctgtagccgccaattcccaaccacttcatattaataagaattaatgaaaacgtattaataatctaataataacataaggttccttggctatgcaaccaagaagaaaagaaaatatcccatttcttgttgtattcatgtccatattctacaccatctcttctctcctccataaccatgaatcaatttattcatgtatcccccaaatcaaatgcatcaatcctattgcttttggaccaaccaaattacctttttttattcacacacttctcaaagaaatgttaattcaaaacttttgttcaaattaaagagaaataataactattagaaatatataaacctatttttagagcttccctctaaagtttgattagacttttgggttcgaatcttttctcttaatatattattaaaatgttttataattgaaatatatagctcggttgaccactctatgttaataattaaatattttgtgagtcaaattagtagaatataagttaatgaagaaaaaaacaagttaagaaagtgagaagaacataccatatatatgatacaaatactgttctaacatccattgtgatggatgagaactgcaccacaaaaatgacaagaagcattattgtaagacgtagagatgtcatataccattcagtacatatatgaactcatgcgacgtgttttgttaactccccattcattctctctttcaactttcaacagaaccctcttcttttttcttttctttttaccttttctttctttcttcctttttttcctttggttccattattagctccattgattgtggtagttgcaaacatggagagcacccatttctctcccaagaaacaagaatccgcaacctcaacagacaaaccctctcgccagattctttctccaacaaaaacaaactcgggtacttctggggttcttgagaagttatcatctgaactactgcaaactcaagaatcgttgctaagtacctcatttccatcatatcctcctagaaaacatgttaatgatggtaacagtaataccaataataaggaagacaaggagggtgcgtggacgcataataaggataacggaagagaaaggctgaagaggcatagggaagaggtggcaggagaagtgaggataccagataaatggagtcaagagagtttacttagagattggatggattactcttcttttgataagttgctggcacctgaaggacttggcttagctcgtgaagcactgataactgaagcacgtagaggcggcggcagctcctctcagagactgaggataggcagcaggtgttttttgatgaatttttaagtttaagtagatctaattagctacattaattcttcttgtttcatcactaagatcttgactttcacttttcatggttgcaaataaataaaagtggaaccatgtgatatttcaattaatatcattgtgttttatgagtgaagtgctatgttactctgcaatttctcttaaaggtactaatttacgtgggttggaaaaattattgtgttaattatttgtgaaagtgaagtagatgcaatagatttagatcatggatgccctacaccatctagagtggaaatctggtggttggatggcttttattaagcaactcaaggatttaggctccgatttttgagagacggttcttttgagagtatcgctcaaatctattgtttagttgaatctctctgtctgcctggcactaagattggtgttgcagtgatggatttaggtcccgtccaaactatctatagctctataaacattccgcaataaaaatgaacccgaattgattatacatctatagtgagaaaaacatcatcatgtatgcagagagttgactaccagagcactatgtaagaaaggtttatggcaatatgttatatatactagattttagtaacagtagaaaccatattcagctttaaaattctcaaaagaaatacatataaaactgagtattggttaaaccatattgatattttctttagtttctaaccttttaaccatacttggagagaaatgctaagggaagagccaaacaaattagtaacaataacaataatttactatatatatatagacacacacatataccaaaaacaattaagcaagctcaatgataagtaatgatttttatcatatattattaggaaaattttcacagtattaatttttaataattcggtaaaacttccacggcagttccataatataaaaatgcccttttgtaactaaaagaaactgtaataaaaatgtatccatgaagatgatcaattacatcaccatggtgcgctcatggtcctcctcaaaccattcagcttttctgcagtttcctcagcagcaattgcctccatttccttctcctcctcttcctccatttgctacttaatatatattcaacagtcaatatatgaattaatctatcatttcaataactaattcacatttgatatataattataaatgaatttatttattcacattcaaataaatatatgaatttatttgatatacaattataaaaatttatatatttttgaagatactcgtacgatttagaaaaacgttttatttgatttaaataaaaaattctatttcaaccgatatatccttagcatagacatacataatatagaaatcacatttaaaaagaatattagctaaaatttcaggtgtaataattactttttgaggaaaaacaaaataaagtatactttctacaaaaacatttttgaaaaagataaaaaagaaataagaaaaatataattttttaagaacaggaataatgccaaattggccttaaattagtttacgttgaataattacaaattctaagtctaatgaaatactaagataagtacaataggcaatagtcatcctaatcttatacaaactcaaacattaaatgtttctcatcaaagataaattaaaacttcatggaatagctaaaatttgaaataagtattctatatggatatagctattctaaaatttatttcaaatttaaaattaataataataatttctgtaattattatctttttgtttgaaaaatatttattttatggtgaaataaaataaataaaaattacgtaatttaaaaaaattaattttttaatttatttatcttagatttttttgatatcaccttctattattcatccattcaccactaagaaagagtgaagttaaaattaactaagaacaattattgaaggtgtttggttcagttgataagaggagttactagctaattttttttaatcaatatttaaatatttaaatatctggtaaactcttcttatcagatgaaggctgaaataaaatatggtaaccgatattcaatcagctttttattttgtgcttttctttatcagctagaattattttttttccattttaataaaaataatttttataaaagagctaaaaaaataataaagacatatttctatatctttttataaaaaaataagtacttgaacatatagttgattgtattctagattattgttattaattgttttatatctttgaaataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttatttttaactaaatgcttgctaaaatctaattttgataatatcagtgaatttttcggcacatttagagagtaaattgcatgaatggataccaaactttatattttgtaacaaaaagataccaatatattaatttgttacaaaaaagtaccattcatgtatcatttgaaatgaaattttaatttttttgttacaaagtgtaacgtttgaaagaattttgttggttatatagtattaagtaattttaactacaattactataatcacaaatacatgtgattgaggttagtattaatccatttgataaaattaaaaaagaaaaaaaagtttcactttcttttcatcctctaaaccaaaagtctcaattttcagttgagatttctggttaaataagtatacttcccttctcacataagtgttttgactgttagcttatttatataataaaataaaaagtcttcacatatttcacctttaaatttaactaatttaattttttaatattttcaatttatttaatttataacatcttttaattttattttttaatcttttacaactctgctaatgtaattttgtatttttgattgattcaaattgtatatagatatttaaaggtattttagagttttaatgatatatttttatatataatatggtgaaaatatatgtctttaccttattttagttttcttttctaaattcagaaaataatgccaaataggagaatttgagctaaaaatgtactaatggactttaattggaatgcggctataaaaagctcgggaatcaaacacataagctatcaatagcttgggcctagcttaattcattaaggcccaaaaagaggaatttgagtaattataatataattaatgggtaattatcctttaagttattttctttaagtttttttttttagttatttgctaaaaaaaagaactctaataagaagatttctataaggagtacaggttaattaaaacaaggagttctttggctattatggataagattctactattctctgcagaaatttatatagttcatcatcttctacatctagctagctttagttgcatcattcttcgaagaatcaaaaaagctttttgaagatgtggagaaagatgatcaatcttcttcattccttgaagggcctttgaactttgagagagttttagttttttgttttacgtatcttaagtctttctatttaattataataattgttggattaaatatgttagactaagttctataagtgtttagtttgactttttacttgtgtatgaaccttatatatattgagtctaatgaattattttttaccttcatatgttcattagtttcatctattattattggttgactattatattaatttagtaataatatttgttatgaaaatcttgaggttaaaagtattagaaacatcatctttactttaatctatattggtataagaaacctaagttgcatcattagcttgagtgacttaagaaaaaaggcacatcactatctcatttgttagatttggacttaaggaaattaagaggattactaagtaaaaactagactaaatactattttatcatataattcatattaatcattctagttgcataattattttctggttctttaatttcttttattaaacgtaagatcattctcaaaacattggcttagagtgtttatatttattttcagtattttgtgagatagttggtttttataatatatgccctataattttctatgagatcgacttcgtggtgaacttgctcgaactatcatacggttcgtacacttgcgagtattaatttagacatatcaattttcatttaaatttttatgatataagtaaaaattaaataattaaaaattgtcaaaaattaaattaataaaattcattagtaatgcataacctcaattgagatttttagttagattatgagacatgtgcatcacatcaatgtttgtttatcaatgaaaccaaaatgggcaatgtagaatctagttttctgttccgtggccttagacaagaagccatgctcccaagatacaattttatacttttttcaactcaaattttattttattttaatttagaatttcatgtacaacaaaaatcacatacctaaaatggaactttgtataatataagacatgacccttattaccatggatggaagatcaataattattactaaatggaaaatgaggtggaggacatgtcgtactggaacatattcattacaggaattaataaatttcgtgtaggatatgcaatcttctatgttttcttaatgaatattttcttttgcattagatttaaatgaatgtttaacagtttatttcactctctctataataaatgttgcacccttcacacccatatgattttctgtcattttaatgaaaagaaaaagaaattcatttctctcatttttgagactagtgggaaatatgttaaactacccaatttatatatttatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagagcagaactatcattataggctctcattctttttagagtgttcgtagaactataattaatttgagacaaagctcaaatcagtcgctccagcatcaattttaaaattaaatatgaaaaattcaacaaaaatgtgatttggatattgttatcgaagacgcaaaagaatacattaaatcgtaattacgccaaaagaaatatctaaaatcttgattcacacaatgtccgcatcttttgcctctgaaaatgaattcctgaagagctcatccttttcatattctcccaatcaaatccaccaaccccacccaaaccaaagctattattattctactaagaactgaaaaagaaaagagaaatatctactgtttcaaaatttctgtttaagccacacaaaattggcaccatcttcagcattgagacgtagagatgtcatgtaccatacaaaccaaacagtactgacgtgtaataaagcctgcccactcgttccctttccccttcttttttctttctttttctctcagaaaataactctttcactgcagatgatctgccatctttgtctgtctgtgagaattggattagtttttagtatgaatctctttattaggaccaaaattagagctgaattttagctgattttggacttaccgcctccattacagagcctgcattactgaattttttacattctataagatcaactgagtcttttattgaacatatcttttataaaaattaatacaataaaacttataattttattctaacaaataaaattaaatagataataaatattaaattaatttacaagcttaacgatccaaatcttttctactataattttagctcgtgtagtaaacaagtctaaataaacttttattgaatatagctataaatagcttattagcatccgatccatttgcaattctatgttttactatcatttatcaatattagtgaggatttatcacttctacagtgagtgtaaaagaataactgtcgtagaatatgtaatgtatagtcttcaagaagcttaggaaaaagcagtttttaaatgaccattggaagaaaaaaaatgatctattggaaatcttgaactatataaacccttttttttttcttctcacttccaagttttaagttgatttctcaatagactttgattaattagttatacccttttagtaaaacaatctgatcatatcacagtccattgttagatgcatcatgttaatgattggtaaagggattttggaaaattcgcaaaagaaaaaaaaaaaaaagctttaaccagagattcttacttatcaactataaactagtcttatatatgagttaaattctataattaattattatatgatatatccttttttttaatatttgatattgacagtctttcctttcttgcatcattgagggctaaaaagaatatggagggtagccattatttctcaaccatgaaagcaaaacacacaccaatagtattgctactatgaaccacacaaactcttccatgagatccagccaccagattcttgcattttcctcatcagaaacaaacaaatcatcctcgtcatcatcaggaatgttgtctgctagagaaggtcatggtaatgaagccaatgaaaataataataatgttattattattaataaaagtgagaaagatcatcgtgatcatgaggttctggtggaaaagaaggattgtggacgtgaaagactaaagaagcacagagaagaggtggctggtcaggttttgattcctgatacctggggacaagaagatttgcttaaggactggattgattgttcttcttttgacaagtcgttggctcctgatggtattgcatcagcccgtcaagctcttgttgctgcatcagcttctcatcatcatcatcatcaacaacaacgattaaggataggaagtaggtgttgaattaatttcacccttttctttttcttttttcttctttgaatattatatatagcttcctgtttatatacagttctagtaatttatatatatatatgcatatgacagataaaaagtggagaacatatatatatatatatatgtgtgtgtatagttgctaatgcttctcattggcaggttcagctggctggaaccagtcttgtaagagatagtttgttgcctttttcatttgatcatgaacatgatgatgaaactgggtatatatgattatttcatgatatgtgtatgagcaaattcaagacttataacatgtttgttctattaattttatttagccagtgtttttctcttgtgatctgtatatatgaagtttatatatcatatttattgttcacacacattcaaaagtaagattttgatgatacactatatagatagacattcacttaaaacatattgcacttagattacaacatgcaatcatatgtatatatatatatatatgattttgatgactggggatagttatacatgcacccagaaaaagaattgtagagattgtgtagaagaaagtagatttttcagtttaggtgtatgacaaagttaagccttgtatgaaaagagatctttaaaatccatgaaattggtgaaaacttatagattgtgaaaatttaggtttttataagctcttaattccatgaatttaatgcattatgttttggtacgcatatccaacgaataggttttaaaaatattgtagaaccgaaaagaaaaacaattttgatagaagatttcataaaataaaatttttgtttatactcggtgtatttttctaaatgtaaattatagaactgtataaacgatattttagattgacatatattcattagttttaaatgataaagtatgtatcgataatccaatatcaaattctaaaacattcatacatatacgttgctctcttattagttgtggcaaatatgctaatcctaagtaagaatctctcatctacacaaaaaaagaaaaaagcctttcgggttttaaattaataggaaatttttactcatcttttatattaactgaataataaattttgacaatcctttcgtatttgtatctaatgtttttgcaactttagtgtccgtaaccaagtctccataatctccaagatttcccaaccttggaaattgttagaaatataaagtcttagctaatattttaaatttctaatatgaaatttctttcatattagcatcaaaacttataaattgaacggtctatatattttcaattatttatgcaaattgatttaatattttgttatatatatatatatatatatattaaattatctgactttctagtttgagatgcacccaagagcatagatatgtccacaacaaaagataatgacaaaataaataagaaaataaataaagactatcacgttcccaccaacttcaacaccgataacgacatccaacgtatgttttgttgtatgggtacttgtatgtactgtatcactacttcatcaaccaagctctgcctatatatacactatttttacatgtgtattatactaatgctactagtaatattgaaataataatttattgatagagtaattttctcatagtagagaagattaaaaaagaatacgttaaatttgaattttagattacaaaaatggatatttagtcgtagaaataaaattatttaagagttttatattgaattcaaattttatctgttgttgttgagaaatacatataaattttaaatattttttatagttaaatttatatagaaaattgaataattcatatacttaatgaatttgagaaattattaactattagaaatattaacctattaagtgtatatatcatgatcgaaaattataatttgcgttttactgatattggtaatgaaaataccaatttctagctttgatttttccatgggtcgaatgcccaccaaggcaaacactattgactgccattaagtggcttctaggatagcaatagcttcaaagggttgcttgagcagtagcaggagagttggtagagcctccatatgaagttgcacacttttggctgtgtgttgcagcttcctgatggacctccatgatgagcttcctgatgagcttggcccttcatgatcaaaggcagcatgttgctttagcctcctgtaatccaagattggcaattgggcgttattcatgtattatgaacattatagaaactacacacttattcatgtagtttctataacttcaaataaatgttgcataattaagtttgtgagatattgaaggtttctataacgtaccaattcaggtatagctggattagcaagagtttttgctctttgaggttgagattttagggttcaagattttcttctgcctcttgtggagctaattttttttattcttttaatactaacaattaacataaacaaatcatatttttaatttttatgggtcacataaaatgagacaattaattttatataattttcaattcttatatgtttttaactagttaagatttactttgatatttattttttaaaatttaacttataaataatataatatcatatttccgttttcataaaaatgagatttcgatttcagttttagtgtgatgaaaacgaaacaatttcgaacgagaattatattttaattctatattgaactaaaaaggatgaataaaattccatttaaattttgaatccaatttaataatttaaactaaaccagctctacacattaacatctaataaaaaattatttagaaaagcaaacttgttaaacaatgttagtatagcaaaaacaatttctttttcatcaattcatgttttaacctaataataaaattgaaattattcttttacatacaccgacactagactattttatttacgtgcatattattccataatacatagaatttcagtgtctcgcatcgttaaagcaattaaaaaattaaaatgttttagaaaattcaacaataaacctcagaatcgttaaagcaattaaaaaattaaaataatattagaaaattcaaaataggcttttattttacttgatttaaaattttcaataaaaattaaagcccaatgaaaagcccacaaaaggtacaactgaatctactcggcccaaaacccaaaaataaagtaaaaagaaaaaggagaaagctagggtttatgacagaacggcttgtataagtaaatcggcctagccggaccatttctagggtttcttttggtgggtactctctctttctttctctcatccttctcaatcgattctttatttccctgaaaatctcttggattcttgtatctcatcgctttatttttattcttttgttcttacagagcaataaacctctaaagactgtttctttaaagcttccagtcatgaggtattcgcattaagatctgacctgttttttgttagctttcttgtttatcatttcatttgctattgtatttgctgagttgttagtgataagttaattgcaatactgtcgtggtaatctagtaaatttagtgtatttacataaattctataattgcatctcaccaaaacctcggtgttgcttttctgattcgtagagtttagcttgtgcttaatgtattgagtcttgtgattttgtatccaaatgtatatgggtcttttacaattaaaggttactgaaatagtgcaattttctctctaaaaattcattcctttagtatgattcaaatttccgtttaaagtaatcatgtcattcatggcctatgatatggttagaggaaggtgtgagagctctctttagtgtgtatttattttttatctggaactggaatattttcatatcttttgcagtaagcttcagagtgaggcgttgagagaggcaatcactactattatgacggcttccaaggagaagaagcgtaagtttactgagactattgagctccagattgggctcaagaattatgatccgcaaaaggacaaacgtttcagtggttctgtgaagttgccacatatcccccgccctaagatgaagatttgtatgcttggagatgctcagcacgttgaggaggtattttaatgctgtccttatttctagagctttttattgatgtcgtttttgtttctgtaactcacattttgtattttcaattttgattttaaattaactctagtagtatggccctcagttttagggaaatgtattcttactttgagggtagcagtttttggtgttcttctggtcccgagcactgaattgggtattggacatcagtgtaaaattttatcttgatctaatatttctcttgctccctaggcaacttttatattatgctaatttcttttatctaattcttatgttgtgaaggaccatgtcaaatttgtttcttctctactttggttttgtatattattgcaagttgttccattactttcttttcatcttttcttggtgatatgcagcactgtgctgtaggttaatgagcttgtatgatttctgctttctattacagcattttggccgtaccttttgattatttaagcatgttaaatttttattttaagatctgtatttatatgggacattcctttgtgttcactatcaatgttttcttatgtattcactatcaatgttatcttatgtgaataacctagtgatcatgttccactctggatgtcttgagcatgctatgtttatttggtttggttactctaggaggattttgttatttgtcattgaagtgcaggaatgatatgtgactttggatatgaatgcattatttttagttaggagctgctggctttccttggagtttgaacaatgatttaaagttattgccttttttttggggcaggctgaggcaataggtctccaatggatggatgtcgaagctttgaagaagctgaataagaataagaagcttgttaagaagcttgcgaagcagtaccatgccttcttggcgtcggaatctgtcatcaagcagattcctcgtcttttgggccctgggctgaacaaggcaggcaagtaacttaggagctttgatgtttagaatgtttgatggctctctctatttgtattattggcttacagcgttgactcacttgtttggaaatgcagggaaattccctacccttgtgaatcaccaagaatcgctggagtctaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgctaaaaaagaactggcaaaatgtgagtgctaaatgactcgtttttttttgggggtctagatacatgtatgagatcagtaaaatgtgttgaagcatctctgatttgttctgtttttgttatggaaatcaggtgaagtgtcttaacctgaagaccaccatgggaagcccacagcgcgtattttaaggagatcttcagttcgtcttttggacttgtttttcttgaatacttatataacagttttgtttttatataacagatcgtacaaaatttatagaatttttccttggcttttattttaactgaataataaattaacaaaatccagaaattcttctaaatcctttttgtatttatgactgcataatcactacctaatgtttttgcaacatattagtgttcgtaaccaagtattaatctccaacattcctttgttttgattccaatcaggagatgttttaaataaaaattatttcttaaaagtcttagttaatagcttaaatttttagtttttgaaattttctttgatattagcatcagaacattaaaaaggtctatattttcagtcatctgatacccacatcttattaatttaagtatagcataaaatgagatagttatgtatttatgtataatataaatctattagaaattcatatacaaatagattagaataagtcaaaagcattagagtaattagatgttatcatttgtctatttaaccaataatggtatctcttttattcttgaaaaattaattaatatgactaggcttaaagatcattgatatattatattataagatgcattgcatcagcgtagatatacgcataaataagcaaataaattaagactctgatgttcccatcaacttattgaaatggggtaatttccttgtagcatagaagattaaaatgaatatatctagttgtagaaacaaggctatttaagagttttagatcaaatttcagttttttatattgctcctcatggatgcatatgattgtaagatgattttgaatatttcagatatttttttatagttgaatttatatgacaatcgaattttcaataattcatgtgcttagtaaattaatgaattattaaacactagaaactttaatttgttaaattagtaaaatatataataacatctgaagtcctactataagcccgaaaaatatattcataaaatagttagatagttttagtaaattttatattatatacgttgttaatttttttttaaaattataatttttataataataataatatatatgcataacgcgtataaaaagaaatactagttatatatatacgatgataaaatattggcatttgtgccttaccaattttttaaaatatttttttcgatcagaatcagaatcacctcttttttattagaatttcataattacattctcaaattccatttgcatatgatataaatccttaccatttaaatttttgatgttttttgttccccaagtactggagtattatatccttatacatataagattgacttttcttagtctcttcttttcatgcttttcatgacaataagctcttttaaacatacacaaaactcatttaaaaatctaataatttctttcttttgtttttggtcaaagtgaaaatcttcacaaacatgtgacgaccatctataattaggcatgtgtttcttctggtatatttttgatataaaccttgggcttttcctgaagactctaaagtcgcgtttaccttgatgacaaacaatctatccccctgctctgagaggtctcttgaaactaattgaaagagacgtatagcaggagaatggtctttgtgggatttcttttaaggcattacccggactgatcgcctcctctggcatagtaactacagacagacaccggtttatctctaaaggtacacacaatagcccagtgggttgaatccccaccaaagcaaacactaccgactgcagactcaatgatacaggaagaacaattaagagtcaaagctgtattaatagcttacaggatagtaatagctcaaataatctaattacatcaaatctaaaacaagaaggtcatgaagatattcatcctcaataaaaactataggaatgagaatggagaaaccaaaaccatgacaaatttcagtgtttccatgaaatatattatatataattttaaatttttaaaaaataaatcttaaaatcgtttaagcaattacaaaaattaaataatatcagaaatgggctttcgttttgatccatttaaatgaataagattcagagcccacagaagagcccataaaagctacaaactcacgctgaatctacccggcccaatattcaataataaagaaaaagaaaaaggagaaagctagggtttattggagcaccgcctatataaatagataggcttagccgcaccgtttccttgttgctagggttttggtgggtactgtctcgctttctttctctcctccctctcactcgattctgtatttcctggaaaatttctttgattcttgtaatcttatcgctctattattgttcttttgttcttacagggctataaacttctcaagactgtttctttcaagcttcaagtcatgaggtattcgcataaagatctgacctttttgtcttgtagatttcttgtttgtgatttcatttgttattctattttcggagttgttaatgataagttaattgcaatgctgccattaaaatctcgtaatttttgtatatttgcataaattgtatatttgctctcactaaaacctcagtgtttattggatttgtagagttttagattgtgcttaatgtttgagccttgtgtttttgtatccaaatggatttgggtttctgttatttagtaaacaattaaaggttacaggaatagtgcaattttctctctaaggcgtgctttagtgtgattcaaatgtccgtttaagtatttatgtgattaatggcctacgttatggttagaggaaggtttgagagttctcttcagtgtgtaattcttttgatctggaactggaacattttcgtttcttgttttgcagtaagcttcagagtgaggcgttgagagaggcaatcactactattatggctgcttccaaggagaagaagcgtaagtttactgagactattgagctccagattgggctcaagaactatgatcctcaaaaggacaaacgtttcagtggttctgtgaagttgccacatatcccccgccctaaaatgaaaatttgtatgcttggagatgctcagcacgttgaggaggtatttttctggtgtccttattactagagctttttatcgatgtcgtttttgtttctgcaacatccacattttggattctcaattttgattataaataaactctagtagtatggcctctagttttaggtaaatatacccgttcttttagggtaacagtttttggttttctggtcccgaacattgaattgggttttggacatcaatgttaaattttatcttgagctaatatttctcttgctcccttggcaactcttatgttactctgatttctttgatctaattcttatgttatgaaggaccatgtcaaatttgcctctgttctactttggttttgcatattattgcaagttgttccatttttttgcttttcatcttttcttggtgatatgcagcactgtgctccatttgatagttttataggttaatgagcttatatgatcttttaatttttattacagtaatttggccataccatttgattatctaatcatgtcaaatttttaatctgctgtatttatatgggtgactcctttgtatttactatcaatgttatcttatgtaaataactgggtgatcatgttccactcttgatgtcttgagcatgctatgtttatttggtctagttactctacaattttgttattcgtcattgtagtgcaggaatgttaaaagtgattttggatatgattgcttttgtttgagataggaggtgctggaattcattggagtttgaacaatgattttaagcttgttgcttaatttttttgggcaggccgaggcaataggtctccaatggatggatgtcgaagctttgaagaaattgaataagaataagaagcttgttaagaagcttgcaaagcagtaccatgctttcttggcttcggaatctgtcatcaagcagattcctcgccttttgggccctggtttgaacaaggcaggcaagtaacttagcttaaatatttgatggctttctctatttgtattattttcttacggtgttgtctcatttgtttggaaattcaggaaaattccctacccttgtgactcaccaagaatctctggagtccaaagtgaatgaaaccaaagcaacagtgaagttccaattgaagaaagtgctttgcatgggagtggctgttggcaactgctctatggaggagaagcaggtgttccaaaacgttcagatgtctgtcaactttcttgtcagtttgttaaaaaagaactggcaaaatgtgagtgctaaatgacttcccttttctttttattttgtttacatatatgtatataatgaataatgtgttgaataaacataaaaatctctgatttgtttttctgtaatggaaatcaggtgaaatgtctcaacctcaagaccaccatgggaactccgcagagaatcttttaaggagattctcagtttgcttttgtacttgtttttcttgatacttatataacggttttgttttttgtattgaatgttcaagctatcagttcagatccgttttgttttatttttgaatttgctagtaacattagttgtaatgttaaacatgagtttctttttaatgccacctcatattgcactggttatttcaactctcctccgcaaccttagtgtggaaaatatgttcttttcctaaagcaatagttgcatccggtgcatgtgtgggcaagtcagatttagtaagttctgataattggtaatttttgctgttgcagatgagttttcacttctcattttcattttgaagaaagttatgatttttaggagcctttggatgttactcgtttaataaaaactgtagtttctttgtcggacttcactttgcttgagaaccagcataaggaaatgtgatactcagtgttctacatctttcactattctacttataagttcgtacactatgttagtctccgcagttagctcttcttctgccaaccttgtagttgagctaaacttgatgttgcctcttatttttcctttgccatcatctttggacgtttgtatgccaacatggatgaactttgtatcgtatgttttctggagttctaaagaaaagttagcacgacctcttagccccttatgaataaagaattttgtaccggtcatccctgtccctttggaatctgtatagtccaaagaattgtaggtggcaggcaattacattgcacagcaaaacccaactgcattttatttgactagtttaagaaaggttctcatttgagtggttactttatgcgctactctggcttttcaacgacaatatgagtgtctgagccagtgggcgatggcagtctttgtgaaaatcaccttaagcatctaaaaggtttttgcagtttacaagctcttaacacttgttacaatttttgctaactgggttggcttggttttccatactcatcttttaagttgttcataatctatcatatgcttccttagttgaaaatgactcgtgttgagcttgtataaacaacttggccgtttagtttactgttatgcctagcattagccatttatattcatgttatgcctaattcagaggaaaaaaaggaagtcacaagcataaatcttgttgatcaattgaattgaatcatagagtagccagcaccaaatcttgaaccctctttccttgatcttaaaagtcccgttgaaagaaagcagaaacaagtgctaaaaaagaagtccttaaattatgaattagaattttaaatactacatacctgaagaatgaaatcgaacctctgattcatggagtttgtataaagaattgtaatgaagtaagagcagtaaacacttttagcacatatgtttttctaagtagcacagacatcacaagtgatgctgttggtatgtgcatgtcagaagaggtctgcacttatgtttaacatgatcattctgctgattcaacagtagatggctgccacagtccttcggtctattgatggaaagatagcaattgctaatgccaaatgattggcggtcgcagttctgagatagacatgttttatttaaagactgtttccattagttgattcactctttctctagcttcaaatcttcactctctgcatgttttatatcagtgagttcatcttcactaccacaggagagccatggatttagccgctaagttctacttccttaagcaatgatgacaacccttttgcataaataagaaaaagaaagggtgaaagagggtctccttgttggagccttctagaggggataagagtacctttagctttatcatttataagaaaaaaaatatgaaactaaagtaatacaagccatgattttagaaattcaatttgaggaaaaaccaagcttacctatgatacgaaccacaaaaatccatttgacacgatcataggttttacatatccaacataagtgtcatttcgtgtttcttttctcttttccatttcttgaggctgtgaatacactcaaaccactaactgcaatatcagtaatcagtctgttgactaagaaagcagtttgattttctgaaatcacattgggcgggagttttgcgaagcctattagaatgaacttcgacaatgatcttatatagaatattgcaaaggctaataggtcgaaaaccagtcaccttatttgtatttttgatttcgaaatcaatttgatgagagtggaatttatataaacagaaccttctccacgattaagaacattcatacatgctaccgcaatgccatctaaacagattcaagaaaatttggataaagcaaggagacatcttttcctggagcctttgtagggtgcatttgaaatattattgcaccttttctttgcgagtcgtatcaagcattctgttatggctcttagtcacacaagggcgaaccttgtgcaaaaccatgttaatatcctcatccaaatggtttgaggaggcaaaaatattctaagaatcatcccatcatttcgttctcccaaatcatttaaacaacctttgatcttattgcaagctctcttgctagtagctttgtgatagaagaacttggtgtttttaatttatcaccactctttatccaatcattttaaatatttgatgtcggcatacttcttttttatataggaaaatcaagtttcctttttagttctctaattttccgccacagctttcaaggaattgattcgaacaatgttttttgacactcctcgttgtccgtaaaagctgcctcatagtggaaacaattatgttttcttctttttgaggcgatatggctgttccagaggaccaagaacctcagaaaccaagattagatgattgacaatcatcaagagcatctctaaagttattaattaggtaattaggattactaattcctgcgccaggactgggtatccacaggaccctgtggacctccactgaacaccatcaaaagaggtaatttcattattactgtgaaaatttaaaaaagacaacaaatatacattagtattagaggtccataaaatgcataaactagcaaaccctattgtttctaccgacaacaaaattccctgaaaacccaactttaagtttgatagcatcaatatttcaaaacatacttctcaataccaagcaattccaaacagagccttgaaagtctagtggtgaagtatctacctcatattaaaatgtagagaatagagattaaagctgttattattattattattttttttttttttgcagattttatttgaaaaaacacaaatttacaagaatttagtgcaacttattgcttgtttgaacttgtcaagttatttatttttaataggagtctgttagcttattttggtcatttatttgttcaaataaatcagttgtacgttagctactcttgggcaaattagttgagtctttataggaattattttagtttaaatagatgtcttactgttagtaaattgcagcagcagtgcaatacttcatatttcagtttctttgtattatcttttttgagtaataataattttcaaatttatcttcattttaagagatagaatttgtgtcatttggtatcggagcctgctgataatcaaatgtttgatattattactcaaccaagatgaatggtggaagtgcttcttcgggtatagctatagaaaagcttgttggtaataattataattactagaagttatgtagggagcttttttacaggggcaggatttgtgggatcttattaaaggtgatgaaacaatgatcccagcagatactacatagaatgccgatttacgccgaaaatggaagatcaagtgtggcaaagctctatttgctttacggactgcgatcaacaaggaatacattgatcatgttcgtgatttgaagtaaccaaagtaagtgtgggagacacttcaaaaattgtttactaagaaaaatacagctcgattgcaatttcttgagaatgaactagctatggtaactcaaggtaatttatctattgaagaatatttcttgaaattaaagaatttgtgttttgaaatttcagaattagatgcggaggagccggtgagtgatgcacgattgcgacgctatcttattcatggactacgaaaagatctgatgccttttgtttcttcaatacaatggtgggcaaattagccttcaattattgaattagaaaatttattttctaatcaggaagcattgattaagcaaatgaccagtagcaacaagctttctccaaaatcagaagatgtgttgtatgtcaaagatcaaaggagaaagaatttctattcaaagccttcatcgagtgatagaaatcaatctagaactgaggagtcgtcaaagaaatcatttaaagcttattacaggtgtggaaaacctggacgtctcaaacgagattgtcgggtgagagtggtatgcgatcgatgtgggaagctaggccatattaagtcaaattgccgagtcaaaatgcaagaaacagaagcaaatgctgtacatgaaagcagcgagtttccatatccatattgggaacgatgtttatccattaaggttcttgaccaaccaataaatgtgacttccaaggagagcatcaagatgatgtgtctccagatgctcatgcttttattgactacagcgaggaatggattgtcgattctggttgttctcatcatgcaactaggaatgatactcttctctatgtggacgatataagaagaaggtcattgtgacagctgataattcactgcatcctgtgacgaaagaaggagatttgaatgatgtgagtgttcttctcaaggacgtttatcatgttcttagttcaaagaaaaatcttgcttctgtaatgcaaataacaaattcaggaagatatgttctttttggtcctaaagatgttcaaattctttctaacgtaaaacacattgctgctgatgttctgttttgtggaaaaggaaagaatctgtcacgaccccatccgtgggcccgtgaccggcactagggaatgagtaggcgtaaggcaccgaatcccgtagtaagcctgacactcactaactcaaaccaacctcaactcaaattttactattattaatatcacaatttacagtaacattaaattttacacaattaaatcagtctgccagaagaactaggcgagacccgaaactacagaaaattaccactgatatccctactattattactgtgaaaaatctaagatttaccaatttacataccaaatcaaacaccacccgatgatgaaggagtcgggttactgaataagaattgcgggaagactaacagtcacgaatctgaaaaacagtaaatggaaactatcagtctcgagagtgaactaaaatcatatatctaaaataattttcaaacatctcaatatcacattatttaatttttaaaataattaataaatcatgctaaccatacgtgtcatgccatgcttacccaaaaataattccacatgcaacgggacggagtacttcagtagaatcctaatcccaactctaatatctcgatttatttcaacacttatgtctcaactaacctcaactctaacatctcaaacctctcattccaacaggactggcacccagagagcaaagctcaactagggactttacctccagtccggtcacttaactctcagtcttagcctttcggctctcttatccaataagactggcgcccagagagcatagctcgatcagggaccttacctccagtctggtcacttaaatttctaaataagccggtgcccagaaagcaatgctcaaccagggacctttattccggcaaccacactctactaagcctagagagcgatgctcgaccaggacagatcctaatctttctttcttaaaactttacctatttatcctttctctatctcatctctctcagatttatattggaacactcatccaactcctatgttctactgccgtcccatcccgagtcatcatgcaatattaaaattagtgataaaggaaaaacatatttaaatggtaattaaaagcatcatgcaaataataataataattaaatgaaaattgaaattgcaaatgaataatcacactaacaaatcaaattttatgcatgacacgtgcataagcgatatatgattttaactcacagattggcgacctcctaactctgctccggtgcctcggttggagcgagccgaacaaacggactatctagtcacggaaaataatttatcaaaacgctgaaacaatcgatcattaatcctaggtctagactcctaggactgactgtctaagaatctcaactcgggagaattctaccgaaaatccggcagaacctccttcacaacacggacattaaccccccgtaaaaacgggtccaagacctgccagaaaatacttcaaatattcaacaattcaaacaacgggagtcgagtccccaaacttcactattttccgactccgccatacatcacaaaatacgaggcagtcaaactgatagacaattatttttgacccataaatattaaatactcaacaaaaaacaataagcacaattctaaatcaaaggatttccaagattaatgggccagagaaaattaccgagacgctcggtcgctcggtcgactcgcctccagccgccggagtccgatcgacgatccgaatacaccatcggactcacaacgatgcgctgatgacgatcccagcttccgatttttcgatctgacacccgatcatccagagagatttgcggacgatctcgaccgtcgatttgcaaatgaagtccgatcgtcacgaaaccggtgccatttcgaagcttgagctgaggagagtcgggatatctcctctgatcatccattgctcgccagagctcgccggaaatgcccaaaaacctcggctgcctccattttctctctccaccgtgaacctccgtttccggccaccattgtcgacaccgccgccgccaaaacaaagctaatgccaagaggagtcgattgccacccgactcggctgccaatgccgccggaaacacgcctggaagccgctgcctcttcgcgctcgaccgccgctgcgctcgtcagcgcacgccgctccgtcggccagcgctccgtgcccccggcggtcgccaccaacgcctgcagcgccccctccttcttcttcttccgcttcctctctctctctctctcattccttcttccccgattttctttcccttcaatatcgacattagcccccgaactttttcttattacaatttggttcctcaactttcttaattacttacaattccatccagcaaaattttaatttaacccctaaacttttctttagcttttcaattgaatctctaactatttaatttgggctaaatagagttattggaaatacacaattacaaaaatacccctgaccgacatatttatttacaaatttccattaaagccccataaaaataaaattatgctttcaatccttattccaaaataaatttccaatttagtcctaacacaaaattaatttaaataataaatttccaacttaaaatttaataccactaatcaattaaaataccaatttttctaaaattcttttataaaaacatcccttacaatttctaccataattttttcaatatataattttatttatatatatacatatacattggggaaaaattagaataaccaaaaatatattctacccttcaaataatttacttaattaattcttaaaatttcaactaattaggtatagaaaaaataattcattcaattaactaatattaaaatttccattaaatcttttcaaattaaaccaaataaaaataaaactaaaattaacttaaatagaaactcattattaaatatataaaaatttctggtattacaaaatctttatatgttttatttgcaaatgatgaatatgtcaaaaaggcaagtcataatgcaagctcaatgctttggcatgttcgcttggatcatgtgggttttcaattgctgcagaaaatatccacaaactaacttcttaatggtgttcctgtttttaaagatattcagcatgatgagatttgtccaagttgccaatatggaaaatttcatcgtcttcctttctcaagttcaaaaagtaaagcttcagcagcattggaattggttcattccgatcttttgggaccaacaagctatactggccttcattatgtgatggtaattgtggatgatttctctcgtttcagctgggtatactttttagaacacaaaagttctaagtttatccagtttaagcatgatgcatgatgtagaaaaagaatttgggttgcaactcaagtgcttacagacggataatgcaggggaatttctatcaaagaattttatggattactgtagtgagcatggaattcagcgtcaaatgacttgtccagaaatctcatagcaaaatggggtggctgagcgcaagttagctcattttacatcaatttgtttgtcttgattacatgcgaggagtcttctaagagggttatgggcagcagcttttcaaactgcttgccatttagtaaattggctgcctctatggccagggacagaatcatcaccatttaagctgctctatcatcgtaaacccaatgtgagttattttcgtatttttgggtctatttgttaaattcatgtattgaaacacaatcgaactaagcttgacccaaaggccaagaaatgcattttggttggctttgatacttataggaagggttggagatgtatggatttggaaacaaagaaggttattatttctcgtaatgtagtgttcgatgaagtttcatgttacaaagatgatgcaaatggcagcagaagtacaactactcttgccctctttcgtgatgactctacattaggaataagtaattcttcaattgagggaggcattcaatctgaggaaaatacagaggccatcacaaatattataagaaaaaaattctccgagacaaaaaaagctaccaggtcacttgtctgattttgtagttgaaaggaatcaattttatgttttcttgttttttcatgggagattcttatgaaaatgagccgaagttgtacagtgaagctaaaggcatttcagaatgggaaaatgcaatggtggacgaaatttcagcacttaaaagaatgacacctgggagcttgtactaaagtcgtataatgccgatttaattacttgtaagtgggtttacaagttgaagaaaaaggctgatggtaagattgatagatacaaggctcaccttgttgctcgtggtttttcttaataatacggtcgagactatgataagacttttagtccggttgcaaggatggtaatagttcaggcaatcatttctttagctactagtaaaggctggaaattatggcaactcgatatgaaaaatgctttcctttacggagagttggatcgtgatatttttatggagcaaccataagaatttatctctaaggaatatcctgattacgtgcacagacttaagaaggcgctatgcggtctcaagcaaactcctaggtgtcttggttcggtaagattgctcaatatcttaatttttatggttttaaatcttcaagtgttgattcgagcctatttattgagagaacacccactgaatgcaccttactcttgctttatgttgatgatatgattattactagtgatgatatcttcaagatgctttatcggttcgttttgaaatgaaaagtttaggagaagctagttgttttcttggtttgaaaattgaaaaatgtgatggttattttatctttcaaaaaggatatgcagctagtttatttcaaaggtttcttatgggaaattcaagagtaaaaactacttccatggaacctaatctcaagttagctagaaatgcaggaaagtccttggaagatgcaacatttttttcgtcaaattgttggtcgtttattttatttaactatcacaagacctgatattgcatttttatttctcaatttatggatcaaccatgtgagattcatttgactgcagcaaaaaggattctttgttacatcaagggcactttaagttatggattaatgtatgagcaatctaagtcattttccttgagcggctttgtagatgcagattgggctggtgatgtgaatgacagacgctccacatcaggtttctgttttaaaataggttctgctgcaatttcctggtgtagtaaaaaacaatctacaattgctctttctagttgtgaggcagaatatatagcagctacaatggctactcaaggatgtttgtggctaaggagacttattcaagaaatggtgactactcaaagtcatccaattcaaatttattgtgataataaaagtgtaataaaacttgcaggtaatctagtgtttcatgctcgttccaagcacatcaaaacccattaccattttgtttatgagaaagtgttatctcaagagattgagtcacataaaatacgaaccgataagcaagttgcagacatatttactaaaacacttgccaaaactaaatttgaagcttttcgcaaggctcttggagttattgagaaataagtttgcactaagggaggctttcagaatttagtgcaacttattgctagtttgaacttgtcaacttattcatttttaataggagtctgttagcttattttggtcatttatttgtgcaaataaatcagctgtacgttagctacttttgagcaaattagtcgagtctttataggaattattttaatttaaatagatgttttactgttagtaaattccattagtagtgcagcacttcatattttaatttatttatattattttttttattaataataatttttaaatttatcttcatttgagagataaaatttatactagatgagacatcattcgatgtaaaataatattaaaattgcactgcacaaatttacaattcggatattaaagttataaagagtcaaacttgaactcataaaagaaagaaaaggaatggcagtagtaaataacagnnnttcatgttaacttgccctaaactcatattaatcagaaggggtaccataattacaagcaaaatcattcattacccatataaagttggggttatgctcaacaaaccttatttggagcctacgcaatttgacctctatatttatattaactgtctaatattatacatatataatggctgtgcgacctcacagtccaacttggggtgcttcatcattttcaatatctaataatattttgatgacacttgttattaaattaagagagagatccctatgataatgaattttgctttcttgattactaaaataatagaaagagatctatagtattgatttttgctgaaatttatggttgccaattaactttctttctttcttggtcaaatatcattgttaccttccattccatatatgaattctttggatgggcactaaatctatgacttaaattttgttgtcaaagtttgaatatacatttgtattaaataaaaaaaaaaagagagagtatatacctaaaataaaagaacttaccaatcaaacatatcttaaaataatggattatacattaagaatggtctgagcaatttgaattgaaaaaagaaattggtcacagcaaaaaaataataattaaatacttaagtcattgtaatatttaataacatcaagaaattttatatttttcttacaaaaatttagaaatattgaatcggaagcctcaaattcttggacttccaattaacaattgaaggagaaaatatattcttgctgcaaaaatgtatgaataacatatcaggctggattcaagaatttcctttttgaaaaaaattaaaaaggaaagaaaaagaaataaaataaagtaaaagcagccgggtcgtgagaaacatttttggcacttagcaaagtgggcatctttctttgtatggccgcctaaagccagtctgcctctcaaaagattccaaaagccatcaaattttcccttctgttttcacctataaaatccgacccacctcgtattttccgcttgccatcaagctcataagctctatttgcttattgaactctcgtaagctcatttctctttgatctcttctattctgtaagctctctctctctctcgatgtgtttgtgtgtattcatgttattttaggtgtatagattattgggtatttgttagatctatttgttttgagctaatctaactagggttgctcttagttttacatagttttgtttcttgacttgatatgtgaaagcttagattgtttgtttgttgagctagatattatggggatgaggggtatctttcacaagtgggtcttcatacttaaacatatgttgttttttgtgggcaagaaaaacaaaaggttgaatctttttcaggtatatgctctttcttttttacactgaaaatgaaatttttgtattctgaatctttgttgttttaaaaccaaaaaaataaaggttaaaggatttttaattacaacctattttttgaacttgcaattttcatcgattcattgatgctttaagtatttcatttccctttcctttcaaaaaagttgtcttttgtaaatgtaatattttcaattatattaccaattcttgatctcagctaggtaaagctccaaaaatttagtgaaaccagtgagaattgcaacaggtatgcaggagaaacggagatattattaggagagattagcaaattaagcctttagtaacttcagttttatggcatccatctatgttcttcactactccaaaaagtgaatacatgtatggaaagcgtaaatcttgatctttggcagcacactcttctcaaaattttcactgatccaacattcctatgatattactgacaccttttaccggcatactttctgagggccttataagtagttgactcttacctttgcgcttagcttagatgaaatttgtttcatgtgttctcttatttttttagcgtctaaaagatattgaactgtgcagcttcctcatattttgttgacaaaatattacctggtctcgacccatttcaaacttgccaccttttatctgtaaatggtgattcacaatttttgctaaatgtaattgttaattagaggagagtttcttggttagtttacattttgcctttcaattgaaactcaaattgatgctaatatttgcaactattggagttccttttgatttcacatacacattctttatatatgtcattgtctagatatggccctgcaaaagtaagtaaggctctaggttggagaattaagttgtgtggtatgtgcctgggcacacattgtacacattggttgtaggatgttatggagaaaaatgcatgtggtagtttatttgattgtatttggccttgggtgcagttacctttgtaagatttttttaagtcttaatcacatgatttttttagttaaattgttgtaagggcctctaggatattaacttcctgtaaaaatctaatccttagaacactaatatgaaatattattagaagaagagtatgggcatccttaacaaaagaaaataaggaacaggataaacgtgccgagttatgaaaactctaaaatgtagtccagttgctgcacatgtatcaagttcatacatgtatgaagttcatactccctcatagcagtcacatagatcttgcttaccaattttgtttattatgaagacaaatatgttacagcatatttaaccaggtcaattctggctagctcaagctatggagaccccttttatttctttctctataattttaggattacagatcccttatgtcaatcaaattccttggatactagatagccaagtactactactatggcagatgatggcttgtgaagttctttcattctagaatgttctggttgcagcataagtttgaagcttgaagaatctatgcttcattgccattctttttataaaatggagcttcgagtgaagagcagagagctcttagttttgccacttctcataatgctccaaacataaattgccttattcttgtaaaaatggattaattagttccatttttttgtgaatatatgtgaggcatacaatgccaccccttacttaagggtgcctgtgcttgtgtttttataagagtatgagagccagcagtcagcagccacttgctcagagttgtacttgtggaacctttcttctgcttctcttcttcctctttctccttttatcgagtcccttctgttgcaactctgatttcatattcttttatgcctctgaaggcttttttatcatgttgactcattatctcatgttagctcctataagagggctgttagagacgtctgatacaagaaattcttctcttgctaagagactccaaggaaccaactgatctttgctattttcaattcagggttaaagatggcaactgtgagggttccctctcaatgcatgttgaaaactgcacccaagagtcagctaactagtaccattatcaagagtccaagttcactaggatcagtaaggagcatctcaaagtcttttggcttgaaatgctcccaaaacttcaaagcatcaatggcagtgtacaaagtgaagctgattggaccagatggtgaagagaatgagtttgaagcctctgatgatacatacattcttgatgcagctgagaatgctggagtcgagctgccttactcttgcagagctggggcttgctctacttgtgcagggaagatggtgtcaggtgcagttgatcagtctgatggttccttcctggatgagaatcaaatggaggagggttatttattgacttgtgtttcctatccaaccgccgattgtgtgattcacactcacaaggaggaagaactctgctgagtgatggaatcaggactaagtaggtgaaggttctctgtaagttgtcaaggattccccataatggttaaggttctttggacctttagttcttttagtttgttactaaaatgttatccatccagattttactggtaattctgttgcccaaatctataaattttcatgcttcaaatgtcgcagatttgcaacattttaagcttcttgtcaatctatttaagcatatggacgtgaatatgttctcatatcaaagttttggcagtctccttctctcctaatggctagatttcattagttgatgcctagattctaagtgtagtaatgaatttagacaaagagagtagctctgaatttcaagttgatttgtttgctttccacttccaagttccaactacaactaatttaattcatgaaaatattatggttctaattactagcttagaaaaataaatatctgatcgcgtccaatatttcttgacatatgattcacaataaattagtttttaagctaacagaaaggttaggtgtctacatccttatattggctaaaacaaaatgaaaactagtttgtgacatctgataataatttcattcccatatatacaaatggatggattttgtttatccatgaaaggcaattcagtccagccccaaactcaacttcaaacatttatatataaatgataacagcttgtaaatttttttgattttgtaatttaaggtggtaacgatttttacaaatggtaaaatattaatttaaacattttaataagtatgattttatcttaaaattttgagattcgtactcgacactttaattaatctaaattcttattatctcgtttatatacttcttcattaattaactttggtgggcttgttaattctggatccttaaattttggtgttacagttttccaaattatagttggatgctgactaaataaaaacaaagggattggtaaaataacttggaaactgtaattgaactaagtctgaatattactaatgaaaattgtagaattgaagctaaggggacttggttaaactcgttttatatgggaactacgacaaactcttaaggttacgaggattacacttgagaatttggcctaaaattgagtcttaaattatagtcctctgtgtctactgttcttctactgctacttaagaattaatttgattgatgttgtaagagttggtgaagtcgcgaggttaatccaccaatattcatggaagtccattagaatttattaacagaattaatctcagaagggattaaagagtaacaggagaggtagcagtccaacaactccccaaaataccactaagtgcagtagccctagtggcaaaagtgcttttaccatgctgtaagggcctggattcgagttctcaaagacagttctatgagacatttatatctctaataacatccttcagatcacgcgttgattaggtctctttcgtttagtctcgtggttgatgctgcctgcagtgaaagaaagctcgtatagtcacgtccaacgagagttgctactactgattgtctcatctcttcttattaatcactagaccattcagatcacgcgttgattaggtctcttccgcttagtctcgtggttgatgctgcagtgataagcttggcctccatctcaagctaaattatgctcttcaaacattctgcgatgaaagaaagctcgtatagtcacgtccaacgagagttgctactactgattacctctttttttcctattaattattagaccatccagatcatatttcttccgcttagtctcttggttgacgctgcagtgataagcttggcctccatctcaagctaaattatgctctttaaatattctgcagtgaaagaaagctcgtgtagtcatgtccaacgagaattgttactactgattgtctcatttcttcctattaattattaggccattcagatcatacgttgattagatttcttccgcttagtctcatggttgatgctgcagtgataagcttggcctccatctcaagctaaattatgctcttcaaacattatgcggtgaaagaaagctcgtatagtcacatccaacgagagttgctactactgactgtctcatttcttcctattagttattagaccattcagatcacgcgttgcttagatctcttccgcttagtctcgcggttgatgctgcagtgataagcttggcttccatctcaagctaaattatgttcttcaaacattctgcggtaaaagaaatcttgtatagtcacgtccaacgagagttgctactactgattgtctcatctcttcctattaattattagaccattcagatcacgcattgattaggtctcttccgcttagtctcgtggttgatactgcagtgataagcttggcttccatctcaagctaaattatgttcttcaaacattctatagcgaaggaaatctcgtataatcacgtccaacgagagttgctactactgattgtcccatatcttcctattattggtacaatgaattgtatttaaatatatacatgatcttggatcgtacaatattaattaatcataaaacttgttttacaaagaaactaaattctgttctagggcatgcatgatgcgatttaggtcttgatgccactatatatgcttgatagtcaagttaacataattatttgtaaaagagtttcctttttgccaaaaacttgcatcacaaacaatgttaatttagtccataaaaatcatcatatcttagtttaacttttttaaataaaaaaatcagtgtgccttcattaattagaatccaatgtcaattgactcatatataatatatatatctttctctcatatattcatattccttaattactttttcatccacctttttcatagcagcttctccttcctcaaatggccaacacccttttcagtaaagcgggtcattcaaaagcttcacctttttattttaaaattctaaatatgattgcttgcttactctatattttgctgtaaatgtgctttgccaagcttgtgccatatataacttattaataattgtctgaaaagaaacaaagaaaagaaaagttgctcttcttgggttttacaccttttttaagttctacgagtgattgtatttgctctctagggatcatgtttgagagatttagttgttcttttcaaacattttcttttccttttcgaacactatttatggcttttccaagggtttagtgtcttccttttgctgaatattaaaagtgcatcatttctttatctagaatctgagaataatggaacctcttttccacttgaatttcaatttttaatgaacatgactcagaaaagttgaagttacaattacgacaatattaagtgatacaacaaaaaaattacattataaaactgttatttcataccatctacactgtataatctttggaggtactaaaaacaagagcattcatctcatcaatgatgtctgaaaatattgagatagtggagtgtttcatcagttcttttggtcattattattaccactttttcaagtaaggatagaaggttatgattattgtaagcttatccatggcttaagttattaaactatattctaagttcgaattagtgtatgtataataagacgagtaagctaagtaaactttctgaaaattgataatcaaaaaaaggattaaaggcaagaaaaagaaaagctttctatgttaaaaagcataggatactaattaccagaatctgatgatacttcattaaaataatacgtatgaattgatgattacattttctatgtattatatagttatgggttttagaaactacttagttatgattgttaatgtttcctgaaaagcatccaaaatctcttaagttaagagagaattaaaaggcagtgatgtaaaattttgctatattcttgctatgtgcatgtgcatcctccttatttaatattgagagtttgtccaactaatataaagaagaattatttatttatttatttattttattgcatttagagtaagaggactatttcaaaaatttgtacattatgatctacaaacaaaagtgagtactagtgattaagtgattaaaagcctaacattggataatgcaatacttaatctatatatatactttaataacttggtttattttcaaatagaaatgtaaaaatgatattttattattaaataattcatctaaaaaactgatatgatttgtttaaaaagtcgatatggtattatgatattttttataaattttgattcagtgtatgaattataatttttttttaaagaaagaagatgctaattttttattcataaaaaaataataaaattttattaaatattaaaataataattaaaaaataatttttaatttttgcaactaaaaatatcaaaatgaaattgagtagtattcttgtgaaagcgaagaaacgagagggcaaacacgtggaaatgttaaacatggggagtgatcctcacatcagccgaccttttccccatgctcagaggcggtgccgaacacgtgcacctcctcagattcgccttaattatcagcgctcttcctttcatattattatttttaatttaataggaaagtagtaagtggcagtggcttattggaccttgacaagattctgtgaccgacatttgtctttgtctctcctcaattcttttgtttccatccttcccgtctttccatagttactccatgggatacgatcatatattccaatttaccccactcaaattacacttactaataatttttaacctcattttcgaaaatttaaatttgaattctcttccatctagattttaaattctattttatataatacatatatacgcaaattcatttaatttgatcaaattttaaatttttttatagttaatttaatattttaaaattaaatcatacctggtcgaaccgatttaattcgattgaatcaaattttttaaatatttataataaaattatatgtcgaattaaatccaattctgatttagagcagtttttctactgagtcaaatgttttctttccaataactataggtgcataaatcttaggaaatagctcattataaaattaatataaataaacttaaatgtaaagtgcttttaatgcactataataatactatttatgttcaacaaactaaataacaaatgttatatattaatgatattattcatagcgttttcacttagccatcacaatattcttagccatcacaatattcatagcatttgatttcatttagccatgccaagtttgaatcttatttagcacacttgacttggttttggtataaatctttgtgtttggagattacatttatttatatctactcaattaagtaataaatatattaatgtaaaataactgtaaaatgagttattatactataaacattcgtctttttatattttctgtaaaagtaaaaagatcgtttaatgcctatataatgattcaaatttgagatcttaatactattattatatgaactaaacttgaagtgttataatcatgacaattaggtgttagttaatagtacttaaaagagaggataaattcttaatactaaattaccacctttaagaaaggattaatcttgaaactaaaaacccagattgagaattagaaagtgttgtctttgccctgaagactaaaggctcgtggttaattgaaccaagctggttattgaacaattaggttcaacttttgctgctggctatccaaatcctgaaaagtctttgtagtcagtgaagaagttattaatattatccaaactctaaggtcaaatatttccattagactaccctgaaagcactacaaaagatgatccaaaaatggaccgccttttctatttgtcatatatgtatgtatatatgatacttacccttttgtcaagaaatgtttaaacactcccaaccctaaacaatttttgtttctcatttagttatataagtcagacatattaatatttggctatttaaatttattttttaatgactatgaaaatttcgttttcaaatttcctctttcactgttaattgaagaaatattattaaactaaaagggtaagaatatatattggtcaaattaacaaaaagggcaaaaatatattggcttaaaaataggttttccataattcccaaaatgtaaattatgcatttgatggattaggcaacaattttatttaagaaaagaattaaaatagaacccaagtgaaataatcagatgtgaaaacatatatgatagaagagactcatagcaggaaagcaatacaatacgtacaagcaatcaagtggagacaaaaaaactcttaatgaaaaatcaaggaaatgtccaattggatccttgtcagcaagaacaaaaactgagttcacatgtacaactgtaggctagcaaaacacaacccacgaacataatagcacaaccttataaatacagagattatatgtaatttgcattggtgattggttagttggcaaacggtgcttttgggttctgctgctgagcggtggtgctgctggttgctagtggtcttggtttaaccgagattggatcagttatggccaccttctttgttcttttaagactccttttcttctttatctcttctttttcaggtttgtttcttgggcttgtaactacttttgctgatgggttctgtttgtttactttgaaactgcaagaaaagaaaaagaattgaatttgaagcttaaaaagtgtttcttttctttttctttgtttgtcaattgctcaagattgagactttctacctactctatcataattctttagcttaagcattttaaaactgaaaactgtgtcattttcttgaatttctttggcaaaataacagattgttattgatgtaagcttaatgggttaatttgatgtgagggaggtctacttttgttctctttgttattagtttgtcttgatttaacaacgagttacttttaatgaagtcaaagaaattttgcattgaaacatctttcttggagatgaatgtgaattgtaatgaaaaagaagtaaaactttttgtgtttggatttttcaagtattactgacaattggttgtgtatttatgggcttgatgatgatgatgatgatgcagttgctcgaattcaaggccttggcgttgggatcaactatgggcagattgctaataatcttccttctccatctcgagttgcttatctccttcaatctctcaacatttcaagggtaaaactctatgatgctgatccaaatgttctagttgctttttccaattcaaatgttgatttcattgttggacttggaaatgagtaccttcagaacatgactgatccaattaaagctcaaacttggattcaacagcaccttcaacctcacctccctcaaactaaaattacttgcattactgtaggaaatgaggtctttaatagcaacgatactcagttaaggtcttatctccttccagcaatgcaaacagtttatcatgctcttgttaatcttggtctagataagcaagttattgtcacaagtgctcattcccttaccatcttagcctactcctatcctccttcggctggaacttttagacaagatcttgctgaatacattcaacccttgttgaactttcattctcaaattaattcaccttttcttatcaatgcatatccatttttcgcttataaggataacccgaatcaggtgtctatagaatatgcccttttccagcctaaccaagggatgacagatccaattacaaatttgaaatatgataacatgttgtatgctcaaattgatgctgtgtattcggcaattagagcaatggggcatacagatattgaagtaaggatttcggagacaggttggccatctaagggggattctgatgaagcaggagctacatcagaaaatgcaggcttatataatggaaatttgttacaaagaatacaggagaagcaaggtacaccagcaaagccatcagtccccattgatgtatatgtttttgcactttttaacgaggatttaaagcctggaccgacatcagaaaggaattatgggctcttctatccagatggtaccccagtttataacattggattacagggttatcttccagaattaacttattcttcggcatgcaagataaatgtaggaattcaatcttcccctttctcaaaactcaaggttttatgaaattgcagatgcttaatttgtaatctccttgcatttacttgttctgcaggttttatctctattcagtctggtgatctttgttctggcatgcgtaatctgtgcttaggagcacctgaattcattggtagagattttgttatgatacaacgaaaatcttaagagagcatataatttcaagaggagtgcttttaaggtgagatttaattccttttatcattgaattatgaccattctgagttactcatccaattcttggacttaactaatatggcctatcacttttatgaatattatttctaataccaaagcatcactatatatatttatgacaagtgagcaaaattccctttgcttctctctctcttttccctctttttcttggatctaacttgtgggagctggctgctggtctagaattggccgatcacatgatgagaatcagttgactttagctactgttggacatattttaataacctctcaaatactctgcaaataatacgactgagatttgttatactctccaatatcttgaaggtagaatccatgtaatgttgcctactcaatgcatgcatcaagtgtatgtttgatgcatactggttttttatgttgaagtgtactttcatggacacattttctaattttatcattctttattagaaaggtatataatggatctccatcctccacttgcaatcatgcatgtgaatctttttctttttttcctttttcccctcaaaaattcttgttatcttcaactagacaaaagtccaaacttgcttctatcaggaaaagacattgcagaccatctttcggcacctatagcacccaaatttcatttctattttcctttttatcatcattttttgtcttttggttttgagccctatccacaaagatgattacttctttgtctgcacactttggtctccatcccaaaatagaatatgtagcatcaatgtctatttcaggttaatatcagtaggctagacattgctgtcagatgagccttctcagtttacatgaatagcagaagagtattggatcaaattacaaatacagtaatattttcattacataatctcttaaagtatcattgttatctcttagctgtattctaccatccaagtccaagtcatcaccttttttctgctatttcttgattttgaaatgctaaaactaacgactcaagtttctttagtatatatatggtacttttgattctttaatataagtttgctggcttcaaataaaagattaatcaaaagaattactagtttatattatgttagatgaaaattatatttcatattcaacatgtgtaacatcaattgatacttgagcataaagtgggctggtggctatcaacatcatggacaccctccattcacatttgatgctatattgcatcatcaatgtcctgtaggggataagattgacagatagacgaaagatgattccacataatcgaccattcgacaaaaagcgattgcctagctaccaaatattttcatcccaagttgctgcataatgaaaaattttaaattgctgttaatttcattaatccatcaaaagtgtctcatggtcccaattcccaccatacttacaagctgaacgtggttttagattcttgttgattaatacctatgggggctgaccttactgaaactcaggaaacatgtaatctttgagcgaccaactgcagatctagctgttactcagtagctggtttgaacagctgactaagaaataaattaatgaaaatgataaagctgttatattcttactgggtggctggtagtggcaggccataagtggaaagttggctaccaatttactttcttggagattgaatgcttcaaatggtagcaattaattatgatatttttcaaccttttgatctaatctagatttataataatttaatattatatattcatgtgattaacatagatttgcaaaatctgcaggcaggctaaaattggcagcaggggttattccagcagtttgcagagagcatctcttttacaagtttctttatataaaccaataaaatattgacagtattgatcactaacaaatcctggattggttattcatctataggagccaaagtaatatagaaaggttttagggaatatggtgaaactaagtttaggcagatagatgttataggaaaaagtaaatggaaaacaaaaacaattcttttacagatgtctaataaggaaaagttggtcaaatctttagaaggctaaagctgatttttttgtttctttcttatatttgtattttatgaactcattagaattttgcagttaattgagcatttttatttaatggaattgaggctttttgttaggaagtgtcatgtttatacaacttttatatcagaagaataacttctgatttgtagcttttgatggctcagagggtgattattattattttcacaatgtataaatgattcttgatgcttgatatattatatagtacatttgagattcattttaaatgaaatgaatcttgtatttggtttaaaagtggaagattttgattcagtatttcattttttaataatattcccctgtatttatttataccaaacataagtcaagaaataaatgatgaatcttattgaattacaatatgacagtagccttgattggtaaagatctaaggatacatcagtgttatacataatataaaatgttgggttttttttttctttctttgttttttttgacccatgaggaaagcccaaccattgagcatattaaagtcttatttagactttctattttgggagcatattattataaaaaaacgtctagggctagggttttttttttacaaagacttcatatattaaaagaaaagagagaggtgaagagaggagaatacacagcagcagaaaagttccgtttcccgtagattgaaccgttggatcgtcgtgatttttggacagcagctacacagcatctgggccaatattttggacggtggagatcggtttttgaggtccggaggtcgggtttcgttggtctggacagtagctaattttctggtgatatatttcttatcttggctctattttgattccatacaccttgatgtgcttacttccaaggatatgatgattttgtatgcctctagtattatctagagaagactttgtattgctcctttgatgatgatagtggatttaagcggccaaaatggtcccgtggtttttccctagtttataggttttccacgctaaaatttcggtgtctttgtgttgttgtgtgcttactgttttagctcaatatcttggtgcataacagtgatattgtgtgtgttctaattgcattaagaacatcctatttgtttgcatcctcagggttcattcaagttgggaaaatttagacaaacagagattaattccgcatttatttgtttaccgtttgtgactgtttttcccatcataaaagagtaataatacaatatgtttaatcaaattcagaatcatgacagatccttccattgcaaagttatctatcaaaagaaatatttctgccagcattcagagtcttaatttgatggtaaatacaaatataatcagtaactggaaaacaaattaagtgatactcttccaagttatttttcagtatcattaaattttaacattttttcttataatacttttgttcatatttttaatgaacttctaaagtcaaatgggacttctctaaaaagtaaatgctaaaaaagttcatgatgtttcttttagttttgtgtatgtaaattagtcaaaacaggatgctcttaattaaggatgcatcaaataatccattgctgcggtagacacatatttcttcagtagattgggtacttctatgataaaattagtaaattcttttaatgctaattttgattatagtaccacatcagttccatatcagttaatgattatcttggcttaggcaatatattagagaattaagagactaatcttgtgttggtgtaggattagtgtatgttattgttggattagtgagtcttgtttgatctttcagtgttattttaaatgaatttgataaacggatattcatttaattattcgactgttcatataaaaaatatcgttatctatttaaatattcatgaattatatttaataactatttaattgaaatgaattttaatcttcgaggtgacatgtagatatttttattcggatttgggacgattttggataataaaaaaaatttaaataaatttataataaattttaaaaatatattatttaataggtttaaatttaaatatttttaaatgaatggatagcttaatcgttgcaaataagattttctctccatctgccatctcatattttcagcaataggaattaagacggacagtttgataatggttcaaattgcaagattcatttcaaagactaaacgacccatcgtataagtccaataattggggagcattaaatggtaaaaatgctgcgttttctttctaatcagtttcatctttcttcaatctgacttgcgggtgaatctatagaacacagctcggtccactacggcggggatctgcggcagctccggcaactgatttttcaattaaggatgtttaaagcagcagtgaggtacttttcaacaaaaccaaagccaaaaatgaaaccaatagagctgaagacaccaccagaacagacacagactataacaagagcaatctctgacattgtcaaagaacatggcccacttactgtttctcagacttgggaaaaactccaggtaatttcactcttttatgtttcaattttatatctttagtgttattcactcttctattttaattcttgtaaaagttgtgtcttttagcttgcaaaggtttgttttttatcagattgaatgttataatttagtatagttcaaagtagctttctggtagaacatgcattcaagacaaaatgcaatgaaaaaagagaatttcttcaagcgataatttaatgattgaaatgtgtagaagaagtaccttgcgattatcagctcaatttgctagctgagtattaaaggtggtaaagatacaaagtacttttggagcatcactcaaaagcctaaaattttggatataagagcttttatgattgaaaagtctagagttggagtcttagagccccatcttactaattaaatatctcaagcacaaggtaaattaggctgtgtttgctcacgcttcaagtacaacggtaattcgcttctaaaattttcactcaaaagccataaatttggcagtgtttttttcagcactctggtcattcacttcacccaaaggcttgggctaaatggttattgggtagaagtattgttttggagaagttgagaaagctttctttatgtgttagaagcacaaactgttttattaagcggacaggtagatggatttcattttcaagctttcttgtgttcattgatgatgcttggaaggatttcagattgcatgatggtaattcatttcattttctgatgatgccgtattctctttctgggtagattttcgtgaagcataaacctagtcgcacttattctacaactaattttattggtctattgtacgccgtggttgtttctgagtacttcttttgttgcctatgatattgcattagtatttagatgccataccagtacttaaatgtgctctcagctacaaacttatacagcaggctctgaggtataaatttttgttatcagagtataacaatcctttttgcattatacaaatgtcggaacttcccaatcctcactgacttgtatcatcctatgttgaaaacaacaaattcctttaactgtattttgatgtgaggctttaatgctaagtaacaccaatttaataagaagatgcccgtcaaagtaaacttaatctttcgacgaacaataattttaagattagcgattttgaataggaaggtaattacaattcctaagtatgacttaagtatttcttaacaggaaattaatatgagctaatttcaaatattgtttttctttgtccttttaaatttcaagttacctatagttgttcttctagtttgataatggagcgtgtatgatttgattgatctatgtttaaccaattttcaggaagttggcctgagaggattgacaggcaaaagccatatgaaaatagttttgaggtggatgagagagagacaaaagcttagattaatctgcaaccatataggccctcataagcaatttctgtataccacttggttcacaaaacccaccatcaagaatgcaaaagcaaagaataatcctccaccacctaagttatcttgaggctgcagaacttgttgaggggcttgtacagcatggtagattattatttttcctgggcagtctgttaagagtcactgaagcttgcttaactgctgatatcttatccttttcaaatccagctgatggttatgtttgagctgctcctgttttgcttggttatctgtatgttcaggctattaagttatgggattaatttagttctttttagttgaagctctgaatttctttgtagatttgtttatacagctccatattgcaaagaggcaattatattgacacaaggcttaattataactttggcttattgattcaacttctgcagtcaagaatgagctgctgcagtaaagaatctgctgcataaacccttgccggaaaagaaaatctcagcctttaattgattcttagtttttttctccagattaccaaaacattgctcattcatcaacaactcagttattattgacgtgaaagtaagcatgtaagcaaatgtcactgttaattcgatacaagaagcatttcaaacaaaaagggaaaatcaaaataaaatcaagtctaataagagtgctactataaatcaaagattatacaatgaaaagttccacaactaatcattcgatacaagaaatggaataaccatggacatgaattcgtcatacattaatgtcgccatgccagtatatcgcaaatccttctctttaaatttttcagtcaaaccctgaaatcacagcaaatgcccattggccacatcaagaacaggagcacaaacacaataaagaagatgataagagcactaactttatttccatggatatatttctcaccttcacaatcatcccacatctgcaagtgaaatagaacaatgcaatgcaaaaaaaattaatcagatccaaagtccattagaagcaaatgcatgctcgattatctttatagaagagggaacttactcaacaaaactatcaaaattgagttcaatccttctgccacttccatcatcatacttggaaaacagaacttgtagcactgaaggtggaattgcatagccaagaccataaagtgcatctctcagctcaaaaaaatcgattttcccactcctgtctctgtcatatatctcaaaggtggcctgcaagtatgattcacaaactcatatttgaatggctagaaaaaatgtggcatcaagaaagaaaaggatttctactttagctgcttctcaaacttctatactacaggatcctaaatgcagattttccattgaacttagtacctaaaagaaggcctaataatttgagtcaaggacaaaatttctaccttataacccaaattttcaccatttgattcacgtaaatagattaacacaaggaaatcaactaaatcttccctgaactcttcttaagccagaggctacaccaagaaaaacaaaaccatacctgcagaaagggtctgtagaccccctaaccactaaacatctaaatagatcataagaatccattgtctcatttctctggttatcggcattgaaaccattccctcagttctttcaatctcaaacctgtttaggctgtagtcatgtattcaagattcaaggattgttcggtacataaaatgactgcattagggacagctaacattctacaattcatttgcaaaattttattctctaatatcgtcgactaattcattagcgaagcaaaatgaggcatgtttccctactgagtttctgattgattatatatgtcagcatcccaatttattgaaatgctattctccttctcctaatgcacactaaagtcaatgcatatctcaatgacaatgagaaaagaaacaagaaacattatgagaccactcacacgccattggccaagacaattccacaaagcagaaaattcatttggccctgttataaatcaacattacttcttttccaaaaataaaaatcaaatctttagcttaaataaagaaaatgtaataggccaaagagcaaaaagggaccaattctgagagcatcgagtgaattcttgaagaggaacatgagcaatctaatagttctcatattaaagcgctgatacccagaagagagtgcttgttgcaactcattctcatcaatatatccacttccgtctctatccaccatcctaaagctcctaatgacatcttggcttgtatccggtgggaaaccagagcacccaccatctaaacgactgttttctgccatataagaaggcggctgttgatggtggtgatggtcatagtcagttggaggagaaatagtgtaattgtgaccctggtggccgtaggactcgggagctggtggtgcagagggtgtgttgttggaagacattagatcattaacacaacaaggctggagtagtgacgcttattgtagttatatcatgtattaagaaattatattgaaatataatattaaatgtaataataaaatacatttttctttttcttgaaaaagaacaaaatacatttttcaaaaattatctttatgatttttcaaatttcatttgtagagatttgaacaagcacattaatatttgcataattacaaatattggatattacacttttgaaatttaaattgctcttttctaacaatataattgtaacaatctagcaccaatctaatatctccccactttgagaccttactcaaatagcaacactttctttgttattaagttctttcttttgtattttactaaagaatcaatccccaaatttcatggttattcactaatattcttttaacaaaatccatttagacctaccatcatatatgttgaggtccattatacaactacttaacctatgcataaatcttgaatatatttatttttgaattaatataattaaaatttactaatttaacttttgatactcttcaaatatatttttaacttatgatattactttaacttatatttttttttaatctttttcaccactatatatgtattcttatatttttatttagtttttatggtacataattaataaaagtataaaaatttctgtgcaaagtgaaaaaaagttaaaaacagaaattgaaagattaaagaaattaagaaaaaaaaaaaagttaaagagtgtgatagagttaaatgttaaattagtaaaatttagggaccaaactatatattcggccattcattttttgctgctatggattaataatgggctggacgtagctttaggcccaatccacagatctcttcaaaatggcgggaaacttcgtctctctaaacgaaccctaaaatttgggattggaaatcgttgcagtaaaaacatcattttgcttttaccgtgatttctagagagagagagagagaaatgtcggagacagagaaagatgagaaaatagtaatagaggagaaagagaaagtagaaaaagtggtgccgcaggtggaggagctgcagaaagctattgtgcgccggttggtgaaggataagctttcacagtgctctcccgacgtcgaatttatcatccccaaagactccgtcgccgttttctctgaaaccgctcgtatatttatccactatctttctgctacgtgagcgttaaatcctcaatatttattttaaagaatttttgttcttttttgttttcaaattagggttgctaaaatcaatttcctaaacttagggctaatgacatatgtaaggaagcaaatagacaaacgatgaacgcagatgatgtgtttaaggctcttgaagaaattgagttttccgagtttattaggcctctcaaagcatctttaaatggtaatcctctccatcctgaatttttattcattagggttactcattactgagtgctaaaaaaaaaatcattctatagaaagttttaagcaaatgactttaaaatattattgcaagaaaattcaatgttctcctaatcttagagttcattttatgtaatttgttcattttggtatttgtggaatctaattgtatttcattatttaattcactgtgcaatatgtattgcttgcatttataatgctaaaaattgaatccctttttaaatccaataagcaacatttgaacaattttacataagataattggtgtattaaattccttttcagctacataatactgctttatgagctacaaaagaagtatctggttctctaggtggaactcaatttttgaattcgaaactttgccttttgtttagcagcagatatcatttttttaggttttatttgatgtcttttaatggtatttttagagtttggtctcaattgttgttaatctaacagtttatcttgttcttgtatattacacatatcactcgtgcttgatctttaagaaattcactctcataattacccttcagttttagttggagcattcaatagccataatcatatgcctttcttttgtgaaatcgtgattatgtcttactggtttaccaacaatttgtcttgcaacacaagcctataattcatattaggaaacatatgtgtctttgggtagagtccttgtaaatagttcatttgtgattgcctgattggctcatatggtcttttatcggatcttgtatatgttatggcatgaaaggtgcacagtgccaatatgaactgtttagtctttaccaaggaattcattaaattgaagttcccattcttactgtaatttagggtacacatgtaatctttagtactgcaatcttatagatttgttttgtattgtagtacttgttatgattcatgggtttctggtttcattgcagagtttaaacagaagactgctggaagaaaggcaggagtgtcagagcccaaagaagtggaaaagaaaaggaaggtagaagaagattcgttatcaaagaaaagcagaggtaaaagcaaaggaaagaaagggaaatgagagaaaaattatgccgacaacaaccagcaaggaaaaactctgttgcttaccctagccaagggacaaaagttggagcattctaggtcaaacttgtattgctaagtagatggtccgaaagtaagctgtatcatttatgccttgatgtcagctgtagaactgaacctggctcgattttagctcagcgagaagtgctagtcacaatattagccttttccagtggcttctctttcacagcttcattgtaggtttttaaaaaaaaaactgagaatatgttctgttgattaatttaatgatatattattggtagtagctgtcacatactttagagcttagagcatctataatggcttataataggttttgtaactgtaaaactttcttcttctgcttattcatccactcagattcttgtaagttgtaaatctttctgatttttatcaggagaaaaatagaagagccacattctcaatctcaaaccattctcgttaatatcaaaatcaagtaaacatttgtcttgttggcacaggttatgcgattactagaaaaattagacaaccatctgacttttgttattgcttgctatccttaatagaaggaaatcatggttgaccaccaaattcccattaaatgctaaagaaaaagtttaaagttatgcaattaacaagcaaacaatacacaaaaaatatcataatgttataagcctatgattcttgggttctatggacagatgctcttactgctataagatgaattcccgttttacttagaagaagcataccagtagtaaagctaatgactgagaacaggaaaatgagtattttacaatggcttcttccgactcttcttgtattcacaaccagcttggcatacactaatgatcttcaagtattgttgaagctgaaatcctcctacacaggtcctaatggctcaggtcttgaggattgggaaccctcatcagcctctccatctgctcattgctcctccggagttgcatgtgataaagactcgccagggtgtctctgagtgttgtttcacaggctctgcggttcctttcatcctgagattgggccgttgaacaagctcgagcagacttcctatggagatggccaaccttacttctctaaagattctcaacatctccataatatttttggaggatatttccctggggaaattgattatggcatgactcagcttgaggtccttgagatctttgacaacaacgtcaaaagtccgttcccaactaagctaaccaacctgaagattctcaagcacctgcgtctgggtgtgaactgcttttctggcaagataccagaattatactctgagattaagaggttggagtatttaggttgcaatggtagcagcctttctggcaagattcttgcaagtctggctcatttgaagaacctaaaacatttggacctgggttatttcaactcttatgatggcggtaatccactttgagtttggatccttcatttccctttaagttcttgatatggcagggtgcaacctctctggtgaggttcctgcaagtttaggacgcttaaagcatcttcatgcattgttcctctctgatctaattagcttgaatatgctgaatctctcgatcaattatctttctagagaggcaccagagagcttcttcaggttgaagaatatcacgttactccattcatttaataacaatttttgtggcccagtaaggttcgttggcgatttgccaaatcttcaggttcttcatgtgtgagctccctcagaatcttcggatagaatgagaaaattatacagcttgacgtttcttacaatcgcctcactggaccaatccctcaggatttgtgaaaaggagggaagctagattaattggttcttatgcataatatcttctctggaccaattcaattcctgaggaactagttgattgcaaatttcttatagggaaccttcaaggcttgatctctccaacaataatctgtcaggtcaaaatttccagcttcttgcatttgatgacggttccttgtgtggaaatcctgatctctgcccttcatacagcatatattgccagtctttgcggtcagcaggtcaagtttcttatataactcggaagcttatagccgccataattacagtattccctttgatttgatgttacagattgtcgccatgtacaattaatagtggatgttaccctcttaagtaaggcctagtttaacacagctctcccttataaccttttttcttataacctcttttggtgttttatttatttcatctgatcataattttgaattaaaaatggaatttcaaaaagatggcggatttctattaataaccttggatctggtgtactgtaagatattgatcttttctattaattcatatggattcttttcatttgatccaattccttttcaattctaaaaataacctgaaaaagaaaaagaaatctttattagttctacccctgctaaaaagaagatcaatctctttattctagaatcagataaaaatggattcgaatcaattaatattggattcattaaatcctaaatctgatccaaatcatagagtacctacaacaaaggaacttatagtcagaaaattcgttgattatagaaatcgtctaaatccttaacacagacccaaacgaagcaaaaataataaaatattcgtaattaaattaatattaatacattaactgttaccaaattctaaaaccgatcattttcttattttattaccagataatctagtattcttctgtataacctcttattacttctttcatggagctcggcggttatagaagaatgacaaaaagaaactgagaagaccgcatcaacaacaacatattttattatgttacaggataactggctctaggcattcacatatcatttttcctgagaaataataaggccagatatgattataacaacttgcaaacagaagcacaaaagaacataaaagaatggtgcaaataatatgacttgaacattagcaactgtaaataatcaaaagaagacaactgaaaaatggatgtgagagctcgagaccatctacaattacaagtcagcaaacataagaggtttcgtgctatttaattgtatcattttcatcctatataaaacaattgatgacgagggaatgcaaacatttccctctataaccataagcatacaacagaataaaattaatatgggcgatatctacgcccattgctgccatcattgccttgtctgcctctaccagaaccaccaccgcttctgcttgcaaccccactgctattcctgctattatttctgtgatgtgaaggtggggtgtgtggttgtacaccaggctgttgcctataaagaaaaaaataatggaagagctctcaaacttcataacttaaaaccaagtctctcattttaactacttattaatccctttcttccctaccttcactagcataatttcagttgtatttacttttataaactttaagggatctagtaacagactcataaggcaaatagtatatggagtaatagaagttgacaaagcctacagcaccactacaataagagcatgccttcaggagtttgaccaatgagaattttgagtgtgagaaagatggtggaactaaccaggaaccatggctccagggttttgacactaagcagatagttttttattccattttcaagatgatgacatagattacgccacaaggacactgaatgcatatgtaagccaaactaaatccgtattgctggttatgccaatcactattttgttatattgattgcccattttatctctctttgcacgtgcatgttttcttgtgttccacagttacactgatcatctctctgagtgtgtgtgtgggtgtgggtgggtgtgtgtgtgtgtgcgtgtggttgggggaggagggagtttattgcatgactgagcagaagtcactcaacatggcatcagaagcaagattaagatgcctcctacccttcaaccctaaaattagaattgagaatatcaaaagtcaaagacagatcaactcacaggacataaccaatccgcccatcaggtagaagcattggcatcattgccattccagcaggagttggtccccttccatagatcaatggctgccaaaaattattaaacctcaacatcaattgaagcagaaattaaaatccaagtgaataatatgatactaaaagacaacaaactcttatcctagcatcctagagcttttatgagggccagcccaatagcacagtggcactaaatcgttctgcatttgtgcatttatgcattgatcagaaggtggagagatagataacatgattaggcaacttctaaaatggaaatcaaacaaggacaagagtgaataaatcaagtatccaaagtctgtcaattagaaaaggcagcaatgatatatcaagggccattgaaccaaaaaaatgcaatgcctgcataaactagccctttagaatggcttgcaaaccattaaacaatagacaactaacaagcaagtttttaacttcacaaagcagtagtcggaagagccagccacgcatgcacatctattcacctgtgcaacagccccatatcctgctccaagagcaccaaaggcacctcctatcagaccataaccaccaccaggagggtaacttggaagtagacctgggttttgtaaatttgacactccaacagacttctgatctgcctgaggttttgcaagcgaacattcgaccacttggcctaagaatcagaaggagacaaacaaccataaatgactagtttactttcattcagttaacaaatacaagtaggatgataatacataaatcaatgatcaccatctagttcatatctttcagtattcttcaatgctttcatagcactagacctctctgcaaaatgtacaaaaccaattctgttcttctcctgtccaggctttgcaggtggcaaaactacttttgtaatttttccatggtgttcgaatagcttcttcaactgatcttgggttacattctttggtaaatttttcacatatatcgctttcacctgtgcaacacagttaaaacaaacagaagttagatgaccaaatagagttcaaacaatatggtctcccaatatatcaaaacaaaaccaccacatcaacagaagtagttctaaatcttagacggattcaccccttcaaattgtttgtatcaatagagctatcacaagtcaaaacaatcaggggataatgcaatttgatcattgaaactggacttgacccaccaagatcttcatagccttgtcctccatcatatttatctattgactcggtaccagcacctcatcataatagctaattagctatgtgataacactctgctttaaccacatattattctcatttcatggcagcatggcttcatataagacgtagcctttaatcactatgctttagaaatatcaatcctatttacaagataacatggatccttgcagagaaggttccatttaagataaaaaaatgtatatatcttctcaagctattcacaagtcataaataaaacattggatgagtttgacaatactagtggagaagctgaagggccaccgcctgatccagaggtaagagtcttgggcttgcagccactaaggtgcaggttaacgctttgagggcagccactccgcaagaatgttgaaggaatggactgtcccaaatttctctcccaagaccccatttcagtaggcccactttgaaatataactagcaaaaactttattttttttttttccttttaaatacctgtgaagaagcagaagaatcggcattttttggttcagcccagcttacagtaggggcattatcacctagcttaaaatctgggttcaccattttctgccttgaatactcagcacatgcagtattatagtagtcaatgaaagcaaagcccttattattgctcgtcttcatatcctgtggccaaaagacagataataagcagaagacgcatcacaccaaagtgaaaaataataaaacagtaattttggaaaacaaaaacatcgagggtggcagaaaatgattatgtaacctaacaggatattcttagtttaaaaaaaggataaacaatatatacaagaactaacaattataatacacactaaccttcaccaattgcacagcagtgactccaggcccaacttcagccacaaccttccgcagatcttcctctttccagcttctaggaatattaccaaggaacagccggtattttgcttgggctgttgaacatttaattcttttaccctgagacagaaagagaaaataaatacaatggcggtcatcgacagaagcagcatagctacaaatgtgagcatctggatcaaaaaaccctaaaagggaagtcttatgcgtgtggcatgcttaattaagtttcaccaagatttttggtcatgcgtcaaagatctaagtcatacgagtcatgcagtgtcatcaactaggcagcatagatatggttcagaagaaagatatgcaccttgaattcagtattatttaactcatcaatggctttagaagctagatcaacacttctaaaggtcacaaatgcaaagcgcttgttctcatttgaatctttgcctttcattagtcgaacctgctatcacaaacagagatggtcacaatattcatcttcaccaaatatgaaagcatatgatttacaaaaagagcgtgtgcatacctctgtaacttctccaacagactcacaaaaacccctcaagtcctcctcagaagcatcatgaggaatgccgccaatatatacttcagaaccatgaggaggacgggcaagaagctcagcatgatttttcctttcattctcatcatcaattattatttcatcacctataatcctcttctgggcactagacccatcaccattattagcattttcctcctcttcctcctcctcaacctcctcctcttcttccacctccactagttcctcctcttctatttcttcctctacttcttcatactcaacctcttcatccatcacctcaggatcatcatcttcgtctagatcgaccttctcatctgactcaactgagttttcaggttcaactggctcagcagctgctgacgcatttcccttttcccttggcatcttatgtatctaagtaaacaagcttgcagggtaactgtgaagaaggtacagaggccagaagagttcatgggaagaagtatacacatattgaaaggaggaaaaaattatcaaaggccaaatggacttgcagttatgaatctcaattgaattgatgtgataagataagattcaagttggttgaaatgtgaaagtcttgttaggcatagtgataatattagtagcattactaacagagataggaaaaagagatttctgaatgacagacatgaggcttataatggtggtgcataaatatcaagaaaagaacgtggtgaggtcagaaaagaccaatccctaagaagcccaaaaaaaaaaatgagaaaaagaaagggagcagcatataagaatttattttaaagaataaaagaaaaagttagacatagaagtctccatgattnnntaaaaatagatggaaggatctggtgcaacaaaagggagaagcaagccataatatgatccaatctcagaaaaacaatattgagttccaaactaaacataccaatctgtgcaccttcctgcaacaaattgacaataaaaataaagactgagattgggaaaggatgctgcgactatattttataagttcagtataaagtaataaaaatagaagtacaatttacaatagctctaccaagtttcaaccagtcgtatggaaaatattcttaataaattgtgaacattttttgttacttcaaagcaataaaattttgtaagcactagttttttgaaagaaatacatttaattgaaaatctcaaaaaaaaaaaaaaaaaaaaagcccgagcaacagggagatttaccaccagatcggtaaattattattatttagaaatactcagtgtataactataaatgttctactttatttgtttctcactctctctttctcactgagagtaccatccaagacatttcttctcaatctttccaatcagtatcatgtgaaagcaaaatctatttgaagcacacacagcacccacctatacaaagatgcggactttacattctctattttaacctaaagggcttacatagaacaaaggctttatcttaaatatgaaacaaagataacgcctttgatcatttaaattaggaatagatgaacactacaagtcctcatagaggaaaatatttctaatagttacattaatcacaaaaccaaccagaccccaatccctatccaacgggtttggattggttatcttatttttaacttgtcaaaattcaatattataagttcgaattataaaaattaaaaaattatttgcataactagaattaaagctgtcaatttaattgctctcgagctgctacttcagcaaatttttaaaacttttgattctctctcttcaatttaagaaggggagcggggggaatctcagcagcggagagctacattccgacacttaaataagaaaaactaaacataagctgagaaaagggagatgcaagttagatgaataaagcagcctcgttcgtgggagagagagagagagagagagagagagagagtaccagagaagcaacgcgcgatgaaaggtaatttagctttggattgagagattattttgttgtaattttagcttccaagtatcaattgatgaagaaaccctaaagccaacaacgctactgctttctcggattcaaacccctttttgtttctttttattactacctgcaactctgtttcctctatacatgcacttttattttatttttttatatttcaaaatacgtggcaatttcaccctttgtttggattgaaaaagaaaaaaagaagaaaaattgagaagaaaatattaaaaaaaatatttctatgttttgtgaagaaaaaaaaggagaaaaagataattattaattttattttatatttaaaaaataaaactaaaaactgaaaataaaatattaaattaatttatttttcatacatctaaataaaaataaagaataataaaaaaaaattattttttaataaaattttccaaagggtaagagtgcgaaactaacgagtttggattggtttgaattgattagttttttattaaataaaaatagcttttaagtttttttttttaaatttatatagagtgtttgtataagtcaaattaaaaataattaatcgtttattcgtgtgttataagattattattattattttgattatagaactaaatttatagatataatttaatattttttaatatttaatattaatttgtaaaatcttaaaaataataaaaaactaattattattttaaaaaagattttattagtacaataatataaaaattatttttaagatatctatttattaatactaccaatataattgatattattatttttttagaattagaaattaatttattagtgaatataatatttacaatattattttttataattagaattattatctaattaatttattaattaatataatataatttaaaattttagtaaaattaagattacaaaatcattttaaaatcgaatccagttctaaattttttttaaataatgtattaatacaagtctaatataataagatttataagaactaaaaatcatttttgtaatgatgtcaagtagcattgaagagaatagtgctcacaagataattagaaaaaatcatgggcaaaatagatagaataaaatagtgttaatttttcttgtaaatataactttaagctcatctaagatcttatgaacttataattgaaaataaacttaagaatatatgtgaagtactttttattttaacacaaagatatgttgtttcatttaagaaaatcaggaaaacattacaaagcacacaacacagaagctatctgagctcatagaggaccaattacaatggaaggcgttttttgataaactatttcgaattctaggaacaaaaacaaagacacaactaacaaacagtttgctaaattctagattctagaacatcatcaatagccgttaccacctcctgcgctgtattctgaataattgtttttcgcatcaccttccatgattaccttcgaaataccttatccttcgcaagctgcaatgtaccccaagtcccaatccttctaccagagcagcacttgtacacttttggagaagttggactctacaactgcaacctaccagctgagtcccgtaagacacaaccatagccaaccgtcgcggggtgaactccagagcgacgagtcctccgaatttgttgggccattcaattcagattgttgggagattgaggaaactggagtactgcataaagcaaactctcgcagatatcctgctgctcttgccataatcttttcgacattccacatatcatgttcaaacatgaaagcatttctagccttccaaagtccccataacacagccacggtattattggatggagttggtactaagcgaattgccctgaatggctatagagttaaaatgtagtggggacagtcgagccacgtcacattgcacagacagatgctgcgcagttttgtatggaagtttccataagaaaatcttgagtttcggtgttatgtgtaacttccatacaaaacgatattagaggtatgaaagcaatgctgcttcaaaattttctttaaataggtacgaaaccttagtatggattaatgtttgcatattattaaattaaaggtgttattgcatgaccaacacaaaaaaccaaaatcaggtccacatcgcaaattttggatcaattagcccataaccaatgaggggaatgatagacataaaaagaaacactaacattaaatagcagtttcacaatcatcacccacttttcgcccaaaagataatataactatttcacattctccacaaaatttatcaactgtccgaaaacatgcaggctttctagggtttctgctattagggacttataaatacctgggaaagccatcttttctagcaaagccaaagtcataatcatatgctgcatgagggtcccaacaaaagatgtgctgaacatttttacagtgcaggaagtccttatttgaaacagaaacaagtctatccttggaagtgtaagcatcaagaactggctctactcgatgaacccaattgcaaacacattccaaatataataaagagatttttgttaacctgtcaaaataataatacacttgcacaagaaggccatatttgtcaaggacagtacatttcgcatcacataattctcaagcaactcaatcgccatttaacagaaaagaaaaaaaaaaaggaaaaagaaggaaacagaaaatattcaagttttctaaccgactgttgatttcctgaaaaggaaaaatactagcacctaagaaagcagagttgtatcaatgttgtaaccgaaggcacaggtgagtcatcaatggctggaagctggcatacaaagagtaaactatcttcctaagtctgattggtgtattatctgtggaggaagggaatttccaactgactaaagtacactgatttggatatcccacttggtcactggtacagaacttccaaatctcatttggcaaatttcatatccaattaaagcacttccaatgaatgtgcaaactagcattttcctgtaccgtgtgtgattaggttttattctccttcatttcatatattccatcacactctgggtgatgtcttcaaggaaagagacaaaacccatgacacttgtgaagccattgccatcaacatcctgttcctcaatgaggtaattctcgaaggcagaggcatcatcctgccctccccggataaaaatcaattttggggtgatactcctgtcttgcttcaacttgttaattgtacttctcagtaaacctggggaagagacatctatcttagcaacaaggcaaagcacattcttttcaagaatgcacttctttgcataaaagcagtaacaaatgataaaaacaacttacaatcctgaggcggaggaaaaggaattgtcggatccgctatagaagagtagaatacaataagagttgtaaaggcatcaaggaaaaatattggactaccactggtaattagagctgcacggctcaaagagtggcgaggatatgcttgtttatctggcgtagaatatgacattaatactggatatacggcacgattaagggagcttgcctccagggcactgcaccacaaatgtagaataatgatttccatggttaattttcataaaagaaaaacagaaagaattctcaagattatgacattaccatgcaagtgaaacataaattaccatcaaaatggcctaaatttacagcccatcaaagtaatgtagaaaaaaaaaaaaaaaaaaaaaaactaatagcacatagtaactataaaacaacatcagtaagataggtaatcatggaaattagccaaatataaaggccaaacatcttatacgctccattgtggtgggacaaataacattagccgaaaaatcctttgcattcagctgattcagtgattatcagtaggccaataaatatatttatgtattttactacagcaacctgccaaccacctgccggaatggggaagggaagttgacatcccatagcccatcaggagtgccaatatcacaatgtatcacatatggaattacatcttttgacaatgtaagaaatcaactctattttattttcttttttaattagttggaatgtgtatttaagaggttatcatcaatacttgtcctaggtctcaattgtcttaaaaactttttggtcatcatcatttcagatccaacactgcaacattcattctctctctagctctttcagttgggacactgatggtcccaacatcaattgtggaacttcataaatacctaaaaagacattgcaggtagatccggtagtcagggtgaacaccttcttcatggaagcggagaagaggatttcgaagcaacgcaaaaactagccgaggtaggggctgcagttgtgggcattgtgagaatgcaacatcgatttgactggttactgaacttccattcttaaactggacaagtttatacgcgtcattatactgagcagtgaggattacaagccaatcatgaagcaacatcctgccctcccgaaccccttgctctagagaggctaaaataacctacaaagtgaacagtatgtacagtcaacatacacttttattcaaaaatgtatcataagtaggaatttaagccatctttgtgtttccttatcatcaacatactcaacaaataaccaacaatccttttctaaagcaagccacaataagtaaacactatatgcaaatcttaggaccttgtgatagatttctgtttaaaaatctaaagttctcttcacaaagtttttttatttggttttaggaatttgaaataattctcttttggcatgtcatccatgtaaagtccaagttaatttatatcattctagtcaacaatttcctatagctacaagagtgccaaaggaatcatgaacactaagtactcgagcaagaattagcaactcagccaagaactgagcaataccttgtgaatgttaactccaaatagggactgagagtatttacattcacatcagttggttctaacatgccaagtaatgataaaacagctgatttcacacgtagaatactattacctgcctctcactttacaaaaagggatgcagaacattcaaccttagatagagtggaaaagaggaattgtatgtcctaaaacatctaaaaactcagaaaaagatgtacctttgtaaattctaccaattatttgattttacatgaaccaaagacttttttattttattaccagccaggtttgggctataatgctgaatatagcctcactcagtaatagaattgcacattcctgttttctttctaacagattataactcagatgagaggagagcaccttgtgaacaagtactgatagcacggcttcaggatcaacactgtcatagatttcatgaatatttcgggcagctccaaattgcaaagttcggatccttagtcgccgtttaagtgagtgtttacctctgcgtgaacatgcatcagataaagattagcccaaaactaatgaggacaacctgatagcagagagaaattgtcaggttatatgaggctggggagaattaacaccatggccccactaaaacacctatttgatatataatatatctgatttgcatgtcacccatgatcgtttatataaaatgagacgttcacttaatgtatcaacaaagtcatacccacttgcagaaaccaatcctgaatctgcaagctcttcagggggcgcgacaactgtgtactgaaatgcaatctgtagtaccggttgttctgatgcatatctacaaaataatacaacctttgacgttatagtttgcgacttatgttcaaaataaactcaaacaaacttaatatattgcagaaaccaattataagctgtgccacaaggggttctgtatcatgtataaacaaaaatgataaggacccaaggctggcaagctacaatgttgaattgtaatgaaaggttgagaggatcccacattattgtttgaaaactagccatccttaaatcaataatgcctgtaatccgcaattttacttccatattcaagtttaagtcaaaataagggcaccttcaaatccaaaatacagcataaaatggatagatgaccattaatccccatatttacagaagaaaaattgtgtgcacatgcatgtgatgatatgcatatgggtgagatataaaaattttatgtgcaatttgaggaacttaagctgtgaaaatagaccaattattccttttttcctcatagcaagacattcagaaatatttgttctttgctaactgccaagtcactgtactattcacccaaggcctttttggtacagatgtaaggttctaaaaagtaggttagagattttctgatttttaattctttatatactgcttttgttaaacctgcttttgggaaaaacgtcaatttgactgcttctttcaaaactcaataatcataacaataaataaataataacttatttttctggaaagttgaattgggaaatgcaattccaaacacagccttgtagaattttggtgggccatatagcctgagaatgcattcagtgaagcaatatgcatttggtagttatttaatgatcctataaacataagaaacaaaattaccctgtcttgtgatattgacaattaaaacaaaatgcatggttcaatatcaaataaaaagatgctacagtcatattcttcaccagtagttttgatctgaaacccaatccattcatgtgtttctaacatggataacgtagactatgatttcagtctgaatattttgatagttaaaaggaggagattgtagattaaatagatattgaacaatagaagaaagagaaatactgtgaaatttgtaaatagcttttccaccagattcttgcaataaaaaccatggaaaaatatatagcggcatagaattaacagtttcacatgcatcacccacttttcaccctaagtaaagaaaaatatttcacagctcaatattaattttatcaaatgtccaataaaatgtggctagcatctttgctatcaaggatttataaatacctggaaaagccttctgtgcttgcaaaatcaaaatcatacgcatatgttgcataagaatcacaacaaataatgtgctgaacattttcgtactgcggatctggaaagaaatgtccatactgcgataataatttaagaatgtcaagtttggtacaacttgatgcaattttttaagaagatggcagtcacttacagaatgaccaggcttaaactcagaagaggtcctcaatcgaagtatacaaccaaaagcataaggtcgacttaacattcgatagctgcaaaagaacaatacacaaaattacatatgaaaaatataccctgcaaaatgggattagaatatcacttttgcaacacagagagtttcttttttcttaattaccaaacaccaataattctatgcttaacagtaataaaacttacgctttatttaaagaaaaaaaaaactgtttttagcagtttaagatatattgccactttcattaaggtgctcatatttacaacactaattattacattagatactcacatgtcctgaggcagtgtcgagtcatcagtgtttgaatataggaataatgagcctccactttcaatactgagaaacttaagggatgctaaatctgtatactcatttgtaacagcaaatatgtccacgcaaacacctgcttgaacagctacagaagcctgtaaaatacatgttaatgcacaattgcacccctttccccaaacttagaacgcagtattaataataataaaagagaataccagatctttgtagaatggtgtctgctctggaagtaaagccctgtctgcatcctcacctttactagcatattgttcaccatacctccttgtgtctagctgcccagctccatagtcaggaggaccagatataaaggcaaagactctagctgcaattgttttcaatcaggcagcaagtttcgtcacatcctcaaatacataagaaggagaaaaggaacaagaatacaatttacaggcctttagtcacttgaaatctgagactaggcagcaaaaatgtaatatgagctcaaactgtatcacagacctaaagcaaatgtgtttccatactctgatccaaggtacttaaatagggcttccattgctacaccaaatcctcgtccacccatcaaaacaccatctagtccttgacctgcacctgtggttcgttcccaagaagttgttggcctaagagtgtcaagtgcagctgtaatacggtccttacaagtctccacctgtaacagaagcagttaattgacaatggtgctaatgttaaactataaaaagacatgaatttcaattattgaacaaggtctgataaccatgctgttccaatgacaataaaagtaaaagaactcatcccatcacctatgtgtacaattgaacattcattcggttactttcactattcagattctcaaaagcagtcaaatgataaatacataaatagaagagaacaaatgacaaacatacaggggccaagaattgtaataaaggcataacatcttcaagctcaattggcagagtgccctctgtatcaggaggaataaacacattctttacaactggaataggcccttgaacatcatacaatccaattttgtgactgaaggtcgcaagcccaaacaaagcacctggagccagagctgcaaaatacatgaaagggaatgttgataacgaaagacaaagtgccaaaaagatgactaataatacatttctgtaatagagatttcaaagaaaaggagaaatttcaaccttccaatgccgcttgcagtgcacttttagtaagctccaaaaattcctctgaagctgcagataattccaggaaatttcatgtattaatagtcttagtaattataaaatcatgcagtaaaaaaaaaaatcacaggctcccgatgcttacaacaaaaagcaagatacataaaccacaataagaactgcattacttgtagagaggcaatccttgtcctacatgcttaaatgacaatacaaaaatcctttctcatttcttaaaccagttaccataagactttgaggcaaacagtttcctacatgaaaatgctttaatagctagtgattaacaatttcagtttattggcgctgcactttttttcttagcaggaacgggttatgatagaatatgccgtgtgtatcttgatgaaatgggcggaatggctacactaatgagccgtgcttgcatttttcattcggcggagttccaaatcgtcaattaatttgtatgtttttctatctccaccagttaattgagaagaattccatagttttgataaacagccaaccaacttggtttatttttaaataactgtggaattcataatgtaataaaatttagagttgaatgagcaattactctgattcagtggtagtaactcaatgatataaattacaagttaaagttaaactgagctataagctactacactataattaatacaaaagtaagctaaagaatgacaatcttacatgacaaatcaacagccgccacataaactggacaagcttgcatcatctcttcatctgtaccttcaattacagaccgacacaataacataaacacgggcatagcttaatcaaattaagaaaaattgttaaaccctaaaacctaaaaatgacttactaggcaactcaagatcgatgaaagaggacatcatttcagcacatgattgaggatgagagtaacgagcaatggcacgagaagagagtccattgagagtcccacagagagcacatgaccaagcccactggtctagctcgcaatacgtgttaaaataaccgtaacaattttcacatctcggtaatgaatcaccgtctgatccataaaccggtgactgcccattctcgtccttcggagcgaatggagttaccgttactccccatggcagaccagacgcttcttgtgcgtcttggtcgagagggaaccgggacactgtggctcggacagccatggtgcttcttttttttttcgttttctgttttggtttcttgggaaacaaacggaaatgaaggagacggtgtgcgaaattaatttccttcaggttggagagggtggagatccacgtgggaaggaccagtggacttatgccacgtcggataagtttggtttacgtggcatgtattcccggtggctttttatagactgtttttacgcagtgtaatcaaataagaaaatgaggagaaaaagttagtgaaaaattatagtatggtgacatgaaatgacaatgtcattacaagttaatatataaaaataaaaattaagaaaaaaaaaaacctacccattaactatattttattaataataaaagaaataaaactttgatacatactattatctttttagaggatgcattgaattaagattttatagattttttttaagctaatcatttttaatgatttttataaaattaatagttttatgaataatttttacagattttatttaaaaatatttttattaattttcatatactgtgatttagttatttaaaaataaatttaattattttgtttttattattttattttctttttatgctttctatgcttgtctcaaaaattattctatataatgttatatgcaactctatatataaggaataaaatttattttattattgtgttaaatttatatcattttaaaattttttacctcggattatgaacactattttttgtcaagacaataatttttttaaaaaaaattataaatcacaatatatctccaattaaatcatcaaattaatgtcatactcgttatattttatttattacatgtttgataaatatttaaaccaacaataattatatttactaattatttgataaatacatataccgacaacaacatgcttaccaacataaactattattcaagtaatattcctaataaaatctagaagtctatatgtgtagtggttgtttattcaaaacaattcattaaatacttcatttaattaatttttttatatttgtatgtataaaaaatattattagtaaataagtttgaaacttaatttttagttcgtgagtttcatctattttttttaaaatcttttatgatggaaaatataattaagaattaaaagacgataaaacaatagaactccagaaaaagaaatatgagttttcaaaaaagaagagtctattgaaatcttaaagaaaagtgaaagagagttattaacaaattttattcataataatgcataaaaagtcattaaaagtatataaaaattcatatttataaaagtcaacaactttttgaatactgactcacttttataaaatttataaaaattgtaattaaatactacttaattttgtaaatttattttaaagcctttaaaagtcaatactgaatatctcatgaattaaacagaatctcttaaagttattatttaatatacttgactgttaaattctatcaaatttttttaaaattttaattaaatgcatcattcttagttttgacatgctgacttttgaaataaaagaaaaaaaattataatacagtaattttaatgaatataattataaaatctaatcaattaaaattaaatcactattgacaaatacatcaatatatatgtgaatatattattttcctagctgcatgcaaaagcttccctcttgtcgattgcaataaaaaaataaataaaatatatatatatatatatatatatatatatatatatatatatatatatatatatatatattatttattaaacttattcaagagtcaaattaatgcaaatttggttgaagtagttaataaattaaacagtttgataaaatttcaatcggtagctaacaaattaaacaatttagttattatagattgctgttaatatattaaataacaattgaagatacaattttttattaaatatattttattatattatatataattatataaattaataaaaaattaatttaaataataaaacatattatagttaaatttttttaactcaattatatttattattaaaaaaattataaaattattttaaaaataaaaagaattcaaatcttaccaataaaattttttaatttcaaatactataactataaatatcataattatttactattaaaaataattctagaatagcattatttattatacaaaattttaattatatgaaatctaacttaagtaaattataatcaataaattttaataaagataatagtatctaactaaataaaataaataaatcaactaaaatgaattataaaattgaggtgatagtgaaaaaactatcggctctgtaaaccaatgaaccaaacacctccgcttatcttttcgctattacaaatttcagacacaacattcacaaccacttcactaacattcaaagatttcaaatttagaacacaactaaaagggcataacatagagggaaggttccatccaatgggaccgatattgctgaaagtaataccgtgctgcaaatcataatataacatcacattggatttggtggagaaaattaagcattcaccaaaacaacagaaccacaatggcagaataattaatcaactaagaatgcaaagaccaacatcctatggactcataacaaaaatgctaactaattaatttccttctaggtattggtggctctggtgtaaatttgctgactagcatgagcagatatcatcctgatagagcctcttgccattagatccttgattgctcgccgtgcgagagacccattgatctgtcgaaaacagaaacaactccaggattaaaatttggtatcaagttgccaaaataatatcggtttcttactgcgatatcaacagatcaaaaacagttccatagtagaaacaaaaccaggacatatccatgtaaatatgtgcatgcagcagggctatgctcctatttcgcagatatagctaccaaaaaagtagtgtttctcagtgtaacataataatattagttttaacttgagccttgctaacacaattcaatccatctatcaactgtagctaaggatagctgaagtttaaatagaattattattagccaagaaaattgcttccctttttacttttcacaagataattgaaataaaaaacatatgaaggcatgtaaatgacttttttcactactagtacactttccatcctcctcattctattttctctccaaataaggagagaaaacttgtgatcattctccttctctattttcccaaacatgataaaataaccttttggcctaatttttccaaatctatcttctttcctctctgattttccctctcaaatataaagtacaatatgcagctcaactagatgtttataaaagaaaagagtaaaataaaataaaggaggaaaatattagggatcaaggatcagtttttcttgtttaagaagatgacaataatgtagagagaaaaaaatcaggacaattttcctccaattctcaccaaattgaagaggagataaaaagagcgggaacgagaattgtactgatgtagtgtaagagtacttgatgccctccaacttattaactaataacttgcccgcaacgatcacttgataaattccatagtttttttaccttacaagtgatcaaatgaatggcaacaaatagataaattggagagcagaaagaaaagataaaaacagagagataaggtgagagtattaccctcaatctatcagacaagatagaaggagtgataagcttgtatttaggaacctcagaaagaagcttgtcataagtagcctggtcaaacaaaaccatgttgttcaccttctccttttgcttacccttgctccatttctacacattcccataattaaaactagaagattaactaaactcacctaattaaaacgaataaaaaaagaattaaaaaaatttggtcaaaccgttaccttcttcttctgcttccctccaccagatttggctggcttagatgacggaggtggggccttatccttcttcggcgcctgcaacaaagacactatttaattttttttgctttcgggaaagtaaatgaatgcgggaaattgaactttctggattaccatttgctgctaaaattgagctgctgctgctgctgcggccgccgcgtgaggaggaagatgggttgattagggtttggagaggagacagaaggaagacaatatacggagtaagaaaaagtaggtttttttattatttatttatgggatataacagtaagttgggctggggattcatggcctagcttatcacgcccattaaggtatactcttgggaaaattagcaatttttggttttttctaatgaatatataatatgctaagattaaactttgttcaactaattcaaatcggtcaaaaaagtatttaaataaggtaatttgtttcaatttacatgtcttctcttaactaaaacaacataatcatttgagagaaaagagtggtcaaaataaaatttatactatataatataaaattgattcgagtaaaatttatataatctataaaatttatttgtaaatttaatttaattaaaataaaaattatgttataatttttcatgattaaaattgtaaattttttatttaattaaattttaacaaaatagataaaatttttaagtaagttttatgttaatagtcaatattttttataatattagttttgttatttttaattactttttttaattttttttatgtcaaataaaataaagagaagagtgcataaacatacttttgtggttagacgctttacatctaaaaggctgtaattctttttgtaataaaaaaatatccttaatttagtttttttacatttttactatcttacattaatatttttatatttctatgattttatattagtataataattatttttaataataaaattattttataggtgatttaccattaaatcaattaaaattttatagaaattgatttaatattaatataattatttttaataataaaattattttataggtgatttaccattaaattaaatatcatgatatttctaaagatattataattttattttaaaattatttctctttatttctaataaattaaaaattatatattaattttatttaacacgaatttaatatagttagttatatgctaaatcacttaataagtgatcttgttattgaaaataaatattatactaatattaaattatagaaatctaaaaatattagttttcaaggtagaaaaaatataaaaaaattaaattataaagtgcttatttgtcgaaaaaaaactacaattctttaaatataaaagcgttaaattacatggtacttttttactttttttctaaaataaaatacttaatggatttcaattaaacgcaacgttaataaatttacaatatttatttaaaaataaataaaaaattaaaaatcaatatattttatttatcatacatccgttatttttatatttagattagaccaccacatattttaaagggtgctcttttaaatacaagaaatgtgttgtggctcatttttattttatttttacaatataaaatctagaaaactatttatatgattattttgactctattatgatattaatttgatatatttttagtattttttaatattatttaactatatcattattttacttgagatttttttagtattgttttttttcattattcatctatgtttaatttcttactgtcataaaaatataaaaagctattttgaacacaaaattgctatatctttcttaacactcttgaattatttattttatttttattttatcgttagatatttttaattaatattttaatatattatagtatatttttaaaatatatatttttattattgtcaaaatacattaattgttataataaatatatgtaatatcatttaatttataaacattgaatattaaaatataaaataaaaataataaatttatctctttaatgatgtatatttaaatgacatatttcaagtatatatatatatatgtatctttattttgatgaatttagaaaaaaaaattaaataaagaaaaaattaaaaaaaataaaagaaataagaaagcgtaaattttaaaagaaaacgggtaccatgaaaaatccttttatttttttttcttattttacttcatctccgcacaaggaaataagggcccatctccagagtccaacacctacgcatcaaggaaccacactcttccccttcgcttttttcaataaaaaaaaaaaaaaaacatttctctctatctctcatcagttcactgcgacttctcggtaagcgatttcaatcgctgatattggattttgcatttactgtttttccgattctcaaaacttcaaattagtaattaattcatgaatcacgcttttatttttttattattttaggtcttttatttatttatttatttatttttttataaattttgattttgaatttgtaaatagctccagcttatatctttcttgctgtttttgttgttttcaggtgttattaataatcatggcgacaaggatggctgttagatttgtgtctagaaggttctcaagcggtggcaaaatacttagcgaggaggaaaaagctgctgaaaacatctacatcaaggtatataaaagaataaaaagaattataattcattattctatctggtagagcattggtaattagattgatgagctttatcagctgtagattctttttaaattactgaatcattaatcttatgcattaactggcattgttttggatatcatcttaatgacgttgaagacactaataaattttatattactgacaaaaggattaatctaggttgctgctttcgaaaaatgatagtgcatttagtgtctggaattagagattgttcatcagaagaaaggttgttaatcacacacgtgatacgtggttcctagcaattgtagaatctgctgctttgttgacattagacccttaagaggcgtcacagtttatgcgtgcagtagattctgacagcagcattttcattttctgtgatgaaattatttggctcaactaagtcataattgcaatctagcttgttaggctttacagttccctttcctttatttatcttggttttgctcatagaaactacaccaccatttttcactcttttctgttgcaaattgattttattgcgtgcaacgcctatttctgcataggtcaagtcccgttgtagaactgtgcaaacacagatatatatatatatatatatatatatatatatatatatatatatatatatatatatatatatatatatatatatatagccatttctttatttagttatattttgttacactaggattggttgctggggaaaaaacaaaatcaaacaactgaactgtggttttggcattctaatttatttgtaggcccagtgattgtaatggagtgcctaagttccatttacaaaaatttccacagagctttctcttgagtatcttgtaatttgatatctgccacatatgcgcatacacacaattacttggtttatgtactgaaatcatgaataactgacatgtacaactctttctaagcttgcctagattgatttaatacctagagtttcagttttcaaaggtactgctaattagcaagcagtgctctactttgtgaggctacattagcttctacctcattatctcatattttggtaacgacttttaattgttttgactttgcagaaaattgagcaagagaaattggagaagcttgcacgcaaggtatggcatactttctgttgagtcttaatcctacttctagagatattaagttttgagtgtcaaatacttttatgggatatctcttctgaaagttgagctccatgaatcttgtatactatggtatatgtatacaggtatttgcttaaacattttatagggcctgccattagaaggaagggaactacaaaaaccactctctgttttgctacagagagagcagaaaattttgatatgaactctctgtttagtttagtttgattgtgtattactgtatcaatcacctgaagcttttatgtgttgccttattcagggacctaaaccagaggagaaagctacctcaggcccagcaactgatgtcaaaccaagtgcgtcagcttcttccacatcaggagcatcaactgacaagtaccggaactatgcggttgtagctggtacagttacagtttttggtgctttgggatggtatctaaattctcgtgggaagaagactgaagaggtccaagactgaggtcaatgtgctcaagtgtgaagaaacacctgctagtttttactaccaaacttggacttatggtagtggttagcaataagcaagacttttcacgccttaacccaatgttcatttgtttcattacaactcgttatctcttaatatttttccagttctacattttgaaacgagaggtgttatatgaggtgagctctcaagcacaatgtttaatctttttgagtacatgaaatgtggccaaggattgggtggcatggttactattattctgtatatacacatgatgcacttactgattttgttctcaaaagatgcatttgttttggctcgtcctgctttaggggtcatgtccctttcaattcaaggagtgaaggggttttacatttggattagtctggccagcaggactgtaaattggagtaaattagctcgggaaccaaattttccagtctgagacttttggcggagcttatatgggctgaattggttaatagtaagatactgtcacagtttagtgcagacaaaattaaagaacacgtgatttttagaaatctcattaataagattaaattgatagaatgagagaaataagtaggataaggagagagagagagagtctcttctcacattaaatgtgtatcctacagtggattcgcctgcctaacagaccctttttcggtaacaatcagaagataataagttacaagtctaaaactaagaaatggtaagttaggcctacaatttggtacaatcaccttgctcaccaacctaacactaaactcctatgccattcacatctttgcgcctaaattctgaatatcatattaaagaactataaattagtgtatataactaaattaaatatcaaatctttttgaatgaatgtgaaaaagaagaaaagaaaagaaaagaatatttttacttatagtctaagggtaaaagaaatagtaataaagcaaaagaaatggggactatgattaggctcaaattaaagagcaaatatactcataaagatcaagaatccaatctttttgtctcacgcgtcagaggtaaatgaaatgatgtataacctaagcacgctagagattgcataattttgaggcttaaaccttccacttcaaatcattaaaaagtaattccagatcttgaatttttgtattttaacaacgtcggtttaatggcccattttatttagtcacccaaattgtttccacagacactgtaaaaagactagttaccaagtttgattttcactttggaaagtgtgcttccaagtttcaactgcaatggagctgtctctggtttgtgtatggagcaacagtgacagtgaaagagtcttataacacaatataagtgtaagtgcaagattaacaaacacctttttcccttatcattaactctcaactaattttctatctttttatcgatttgtattccattatccctccatttatttcccaccaaatcctaagagagagaaaatagagcaattaaaaaaatcaataaaaagaggaaagagttaatgattctcacgtcccactacttttcttgaatccaactcttctacctttctcaaaatctctctgttcctttcagcaacaacaacaacagcaataccaaatcttgttttgttttcttgaaggaaaaagacccttaaaaatcattcttttttagctttcttgtttcttgaagcaaaaaagatccataaaaaacaaatctttttttagttattttttaataattccattaaaaaaaccaattaaacaatctttttcattgccagccatgactgaggttcttcattctccttctcatttcccttcttctccaagcactactcaatcttcttctaattcttccttatcctgtgcacccccttcttcttttagacaaagtagttacgttggcgctggtggtcaggaggaggatggtggttttatggtgagtgagtgtgaccctgacgaggattttgtgaaagaaagtgaaaagaatcaaagggaacagctttctttattggcacttcttgttactatttttaggaaatctttggctgcttgtaagagtgatagaagggagctttgcgctatggagatcggttggccatccaatgtgcgccacgttgctcatgttacttttgatagatttaatggcttcttgggtttgcctgtggagtttgagcctgaagtgcctaggagagctcctagtgctaggtacattgtgatttccatttacttgccttggcattcatataattattgggtcatgatcactttggttcatgcaaatgcaattcttgaaacaatttatttcagttgaattttgctacttttgatggtttcgtttagattatgcaatttgattcttgaaattgtgatttttctgcactaaattcttcatttttgcgcgctctttctgatatggtgtgggatatgctatctaattctagaaccgtaggttgtttgtatcagcactgtgattttccccttcttttatgatgtgttgtgctgtctagtttgccgtacttgaaatgtataattgttgtatccgagtagtacatatgttcttgaggttctattgatatgtttagtccttaagattatggattttgtagcaatctatagtgtgtttctatgtttttttctccttcgatgttgatgcttctaggaagttctgctaaaagaatgtcaaactggtggatggaagagttgaaggatcattaggtgttataatctcacatttgatactgttactgaaattgtggacgcatgtcaggtcccaagagataaaagcttataggatttctaataatagtaatgataatagggacttaatgagcacataatgtgaatggatctagtaccgattttagcttatcatgcctccatcatatactaaaaactgtgctagtttgttgttaaaatgcatcatcaataataaattggttaggcaatttatgaggaaagagaaggttttgaaagttcatgggtatgtttaatgcaacctgtaaggaaattcgaacctgttctatatctgtgttttatgagtctttggaattaatttctaattctaatgtaagtggcacatagctcagttggtactcccaccaatacatacataacttgaaatatgttagctttttcgaactaaaattgaactttttataccattaggagacaaaattgctgctaaaagacaaaataatacacttgatgttatgttagccaaatcaaagaacattcatgtgtcaatttcaccttaatacatgaaagtttgagacttcagattccaattaatttcaaatgctgagataaatcctagtggagtcttctatggaagagttttggtagatttgttgttgaggttctttgtggattttgttatgattgatagtgcgggtttatgccttttcctcctttcaggtttagatgcttctaggaagttctgtttgtacatatatatttttttacagcaccacacattatgacaatcactacttgttaattattaccataccatttaggtaagtttaccttcctgcttgccactttgccacttgacacaaactttttcataattgtagtgcaactgtgtttggagtttcgacagaatccatgcagttgtcatatgattccagagggaacagtgtgccaacaatactcttgctaatgcaaagacacttgtattcacaaggaggcttgcaggtaaatattttgttatttctctgttaggatcaataggctggccataaagcatagtaacatgagaaaagaaaggaaaagcttttttaaaagattatgtatttattattttgttggattttgtttcctatcaagttgggttggtcacttggctgtaatttgtttgataattgctgcattcaggctgaagggattttcagaattaatgcagaaaatagtcaggaggagtatgtgagggatcaattgaatagaggagtgataccagatggcattgatatacattgtttggcaggacttatcaaggtatggcagcagtcaataactgtcctttcttttttctgttaatgctttctgcttgtgacatgtttaatcactacatctaggtaagtattcatccaaaatgaatgaaagtggtttctgctaggagactgcccatagctgttcaaagattagctatgtggtaaggaaatggatgccgtatgatcggaatggttaatgaatcaatgaaggattatgtgcttttgtttgttgaggaggtgttggtgttggtgactggaattggaaaaatcaaatgcatatctttaacaatgatgttaataaatgaacctaattattgtcgtgaactttaaagttctgttaaatctctaatgttgctgattgctaacgacttctaagttccatctccacggggaaaacatgtaaacttggttgacattattaggaataactaatgatgtggtatcaagtaggttgaatgatgtcatgcattatagcacgtggtaccataaaataaatgtttgctttagattatgaagaagatttaagctcggtatatgttaaccttgcttgtctatgttcctgttacacaagaagtttaagtgctgggtcaaacttatattccaataccctgtatagttaaaaagcaaacttgtttacatttttttttccttgcagaaaccatttcaatgagattagttctgttttactttgttattaagctttgcattagagattgattgtcaacatcgctactgcagtcaacctccataacaccaacatcaccatggcttttattttttccacaaggatagcaataatcatggaagcttgggctaaagttgtttattttggaataaaggatgcactatgaatgaagtgaaaactggagatgggtgcatagctctaatactaatattatcctgtatttttccaaattcatttgtcatgttattttttggtgtcatgggtgccagcaaacagtgggtgctcctttcattgccaacatggattccttttaccattttttttgcatataagatttatttattaacttcaagtgtgatttcatctaggcttggtttagagagctcccaactggggtcctggattctctatcacctgagaaagtaatgcagtgccaaacagaggaagattgtgctcagcttgcaaggcatctaccatatacagaagctgctttactagattgggccatcaacctgatggctgatgttgtaaaacatgaacatgtaaacaagatgaatgcacgcaacatagccatggtttttgcaccaaacatgactcaggtaagtatgtttaaattctaaaggcatggaaacagttgaattaaagaaatgaaatattgcccaaactattattgataatctagttaagtgagaagaaatggtttttattgcattggaactggagagttatctttggctgacagaatagtcctgatattcttgcagatggcagatcctttgactgcactgatgtatgcagttcaggtgatgaactttcttaagacacttatcttaaggacactgcgagagagagaagattctgtattagagccaactcctacttcacatcttgagccatttgatgagaatgaccaccagagtcctttactgtattgtgtggaagacgctaaatatgacaatgaaaagacagatgaagttttcgttgctgaagaacctgttatagaatcttcctactctagtcaaagcaatgtcataactaatggagaatatcacagttcctcaatctctgctgaaaagttaattgccaaagagcttcaatcttgtgaggctgctgctgaggtcgatacatctaccaatgaaacatatgctgtcattgtcaatgatctaaaggctagtgttcatacaagtccaggaaaaagcagtgttggtcaatcaagcagttcaaatctcagtaagataaataggcagcaatccatacttcgtctagcagcatctgttgagaagactcggggacttagcaacttgagctgtataggttcaaggacagaacttattgaagcttggcgatgaaagacagatcgacagttgggccctaattgcttccgtaaataggtggcactatttgtttgatttcaacgttgtgagagaatgtgtgcttgctatgtgctgactggttttctgattttgtggatgacactatgctgtgaaactaacatcttatacttaaaaaaattacagctagttccattaacaatgaaatcaattgttctttagcattgtaccttcttatgttatttacttattagcatttaccatctatcatttagagatggttggtgggcttcctttttggtaaatattttctttttccagatgagaaatgacccttaatcctactcttgtttctgctaatattttaccataacatttatatgcattgattgttgggaaattttacattttaatcttttgtttgtttttgggtagtagttgtggtggtcaattttgatctgctgcactgggaccagaatatggagattttatttgtggtagtgctagcaaaagccagtaaaatattgtggcaaaagagagtcacacgactatggctttctatggttagaacaacaggagctactttcattcgtctggcatcttttcctatctaagataagttacttagaaaatgggggacagcagcccgtcattttcttagaaaaagaatggacatgtacaaaggatcaatcagaatattccaagcactgctctgcctgcaatagaaattacaggaaagtatcagaaggtcttgactgtggctcattccacaatctgatgcaaaattctgacaaaattctaccatctaaacattacatggtaaggttaacatcgattgattgatttagagatgccaggacgcagaggttagtacctcaatattcctgtgaaggacaatgtgacatgttcttacggaaaagattggacattgatataaacttcgtgatattaacaaggcagttcctgcctttcttagtccttaacttgcatcaccatttctgatcacgtcttgtccaagattagaatataatcacaagttttattccaatcaatcagcatattattgcaataaaaatcttttcgttttggtccaccagatgagctgtgtaaggacaattgactcataaatctgtgtctttacattaatctctcatcccatgccaataagattctaaatcaaaagttacaaaaattgcgaatttctattgctggaattccgcgttgcacaatgcagaagaagcttggtaaatattgaagttaaaaaaagaaaaaaagaaaagaaaaagttctgacaggatgtaaagatgtgcagcaggtgtaagccctatttcacatcaggatacagcatactctggacaggacagcagaatagcaatatcagtaccagataacatgctctttcacaggatttccctgaaaaaggaaatcacttcatcaaacaaaagaaagaaaaggttgtggtccctctccctctccagacctaccaagtcatcaatttataatctaagttggttatggtaataacagcactaccattcatatgccataaagttaatctgagttgaattttatacacccgaaagttctatttcagttatttcctttgccaccactacaacaatgttggatgcagcttctggaactaaataatttattcatcagatatttgtatctactgtcagagtaagccggttttatatgttgataaatccaaatatctgggatgaaaaatatttgtacgtcgaaatataaatataaaaaattattaaaatcgaaagaaagattcatgttacattctggagtgatgaatttaaaactattttgattaaaatttttattttatatccaaaatactcttgtccaagaaatacacgcaaactcatcataatttcaaacaaatgggttgattttggagtaggaagaaaaccatccatattttgtattattaaacttgtaggaaaattctccatattattttcccataaattgatgaccaccaaaactcagacccatctccaaaaccacccatccttattcccctccaagtggaaaggtatccataaccaatcatcaggatagggaaaaaatattaggaaaaaaacttacagaaaagcaggaaaaaaaagggataaatccatccatctaactagcttccctaattaatagcatcatctattgattttttcaatccatgccaatctcgtgcttctttctctcaatctatcaacaaaatctctctatcttctttatttctttacttctttcttttctctaaaagcaacctatacagctcacctatggctgcctgtggaagccttcaacatatctttgaaaaaccattgcctgaaactcctacacttcttgaatccctctcttcatggaacccgatcaagaccataaaacccattgagcaatcttcattcactgaaatatttggggagcttcatttcaaagaaaattccgagtcgtcatcatcttcaccttcttttcctataccatccttctcttcttcttccccatcttcatcttttattggtttaatcccggaagcagaaacttcaaacctcaacaggaatgatagttttgacagtggatgccacaccaagaagagtacatcactggactcgttattaagcacaccaaagaattatcaatacgcaggttgtcacaggaatggtgacagcttttcgccaaggaactatgagagcttgcaactgtgcactgagggactcggttttgaaagctttgatgacgtcgaggacttgaagaatgatatgaatgaaaacaggcaacaccaagaagaaaaagcaggaatcacaaggcattcggtactggagagtcaagccggagaaatcaggcggtccaggttaaggataggtgcattccctccaccgatttcgtgtatagggaagagcggaaaaccatgggtttccttcaaatcttatcggcatgatgggaggttcgtccttaagcaagtaaggatccccagccaagagttcttgcatgcacacagagaagatgggcgattaaagctgcacttcgttcagccaaacgatggtattcatgaagaagaggagggagaagaagagaacttcacagaagatgacgagcaggaagaaaatgaagaaataggcaacaaagaagttcaagagcaacacaatgctctctggtaggattaacttttaacttttgcttcactgtttctccttcaactgtttttcttctccattcctgcaactgtttctcttctccatttgcaaatatgtggaggaaaaagaagaaaatagtacaagtgtccaagcgtaacttcctctcctgcattccccttcccttcctcttttccttgaagtcgcttacaatgatttgtttctatcactgtagtaaaattcctattgctgtttagcagagtgacatggatctataccgtaccactcaaaaaaggaaaaagaacaatgattacacgatgaattttgctaaagctaggttaatgggcatcagcatcttcatacatcaaacacactttaagaagggaattaacttcatgaactgtccgacccaaaatttaaaattccaataactcaaagagaccactggttaagttttcatttttaaagaaacctgcagttcacaaaggccaataagccagcagcagtagaagcatcccatagctcctaattaactatgacatcataatgcgctgaacacatgatggaagtagaagaaagcattcaattcagccaccttctgctggtggctgaaaataagaaataaatgaagacctgagatagctagcaccagttatgtttctttcctttttccctttgtgtgcgcgtgcgcgggcgagcatgcaagtgtaaataacatgcacgatcactttattcctgaataaaccaatacttgagtgattaaattgtaaacagtatataggaagtcgatcaaactcccggatctcccttttatgaatgaagacaaatcttgagttaatgtatatatcaggtgtataaagggttgattaaagttctgaaatgattgccctaaccaaaagagaaaagaaagcacgtcagaaagggccatcttacatcctatttagttatgccccaacaacaattaataccattccaaagatagattctgggagcaatctcttaaaacaagttttctagaaatctattagactgaagatatttaatggacgataaacagacctctgaacacatggcaaggcatagatcctaaatctaaaagcagctaaaatatttgtttctgtcttgtccaataatatatggatggttctgagacatacatgtcataaataaagcaaatctaaatcaacggttctgacacttcaaaacagctctgccaattacttgagcattattgccaagtaggtgggatttacgtccggtgcactatctacaattacaatatcgccaagcaggtacataccagtccctatctacaattatgtatgcaatcgttttagtcctgaaatatattttcaaactattggctcatagctattcgtgttgtactgtatgtaccttgcatgaccatagaaaacaggaaaactgaacagaatcattgctaacacagttgacacaaaccctaagattatgcatgcaccccaacccatacgaccagagaaaaagaaagatagaaagttgaaggccacacagcaaatcaatacaaacgccctgtgtcttaaatgaacgcttgaaagcagaactcaggattccaatctaacgaaatcaactggatcaagcggacaaagagtaaggaatgggaacttttgggaccacacattatcactttgcatttatgtattgacatatacaattgtgcaagtgaaaatcctctaatggatagcggtggaccacatagccactacatgtgacagtaatgtagctactttttaaatcaagaaggccaaaagaaaggaacaaacaagaagtaaatggagaaaaggaaagagataaaggcacagtgatttatagaccataaaacaggcctcaggttaaaattctcattgatcttccttcaaacacttatgatcttttctttccatcattctacagatataatttattgtttaggaatatgttttagaaagttcacaagttacctctacaacaaagtacaattggaataagcagcacaagatcactgagatggaatatggccatctaatgtcaaaagaaccctgtaaagatcaggacgtcgatcacggaataccccccagctatgtcgcttggttttgattttatctagatcaaatttagcaagaagaacagcttcctttttgtcatcagcagctgcaactatttccccagttggtcctatacaacaaaaaattagttgcgttcaatatgttcactacatttatatctccatttacataaagaaatgccagaaatttattttgagaaggaaaaaaaagagaggatacctgctataaatgagtttccataaaatgtgatcttgctatctccatgctctgtttggattatttctgttccaatgcggtttgatgctactagaggtacctgaatttgtaaaagcatacatcaattcccttcccatggaagtatatgaaagatcccactgagaaaatattgcaaacagaagatgttcataatcaatcccaggcctagattacaaccagaaatgcacttcatccacattatggacagttgcctcttttaaaagccaacttagatcatgataacatcatttattttttaagcatttcagggtttttttttttgtcttttgtgcaatatatgtgcttcatttcaagggctggaagcaaggacaactttgagaaattataaattgtggtagaaacggaaaatggaagggtaaagatgcactagacaacaaactttgcttcgagacacaaaagcaacaaatagaggattttgaatacataatcatcctaataattttaacaggacaggtgctaatgggactagacattatttaacatgaaacatgaacttatagaaggcaagcaaaaataacaagcaggacagaaacactaaacaggaacaagtagtcagtgctatactaaaacagaatcaccagtctaccagtattctgcagcttgcttaccagattagccccagcatggccttgcatcactcgcttccagtgatcatgggaatcaagccccatatcttgaggttcagaaccaatagctgttgggtacaataatatttctgcaccttgcagaaccatagctcgggctgcctccgggaaccactggtcccaacatattgctgacaatgaatcagaaaaaggaaatgaattgctgccttggttactagcacaatcaagactacctttctttatgtaaaaaatgaaaatagcaccaccttctgtatatagtaaattaatacgtagttttatgtagctgtagcatggtcgaggactagcatattttaggaagggggagggaggggaagaatgggagtaggcttcttaccaactccaattttagcaaatttagtttggaaaacctatatgacatcaataagaaactaatcaatataattaacataaaatatcatagtttcagaaagttttgaatttagatagagatgtataagaaccaaccttgaagccagtgtcaccgggattaaagtagaacttttcctggtaacctgatggaaaaggaaaatgctgtaaagaaaccgcaactgttcaagttgtggaatgttctgcttaacacatacctggaccatccggaatgtgagactttctatagagtccaaggtcagtcccatcagtatcaattatggctattgaattgtaatgggcattatttgcctcttcaaagaagctgactggtataaccacatccagttctttcgccagtttttgcatcctgcatggtgcacatttaggatacaaaatgagttaaacgtattagaaatgaatgattcacttttagtgtcttcagttggagtaacagccatcacattacttaataaagcttgccggaaacccagcagctagagggggcaattggattggacgggtacaggttcaatccatctccagtttaagtccaaccctaaatggatcgatccaagaacagtaaattcctttgttgcaaataaactgagaggaaatgcagctactgaaactgttatacaagttcttgtcgaaagagagacagtaagttttgggactgttcagggtcacctaacatgacctttggtgattcgccgcctaaaattattcagctttctcaagttattttagcaattattttggtcattttaccttctcttcggttttgtcagtttaaaattaattttttagggtcattttagttaatgtcacaactcacccaaacaactccaaattcttttagatcattttgttgatatagtcaagtttgacaatagagtaggtaaaggtgggttttcgattatagggccaaagattgctacctctaccaaaggataatgatgctctgtagcttttacctcgaaattgtagggtggcccttataaggcttagctcgctgaaaaaaatcctctctctgtgcttgacagaagtaatatccttcaaatagttcctgaaaatgaagatcaaaaggttggatacctcaaaggactaatgaatgcattttccagagctagtttgccagaagtttggaatcaatcttgcccttatattttagtcctgtaacagtttttactactaaatgagaatttgactaaacctcttcttatctacagaagcagtcaacagctgtggataaatataaaataatttacatgcctttcaccatcaatatcatcagtatcactgtaatatttaaattctgattcacataggtctttgcatttggtttgtttgaagccctttatttttttcagtaaacttataactgttagaataagattttattaaaaccaatgttctctagagaaattagttggtattatgattttatttaacacatttaatcaactcgtaacatctgcctcatcataataataaattaacgttcccacacaaaaagaacttagtttgaggaggacaaaagggaaggtccacgtgaattatgtaaaatatctggtaaccaatggcaaaactgttgcaaatatagcaagacgaatacacaaatgtgatgcaatgtactacacctctttattttacaatggctgaattgaagtgattcaattttcttatatattgactccaaactaatgaaaacaagtataacttttttattttttccaatgcatgaaatctagaatttgctagaagaatgatgtagtctggagagaaagataacatgatcgttaaccttttaaaatttcggataaacaaagataatgaaatcatagtgtagctttaaggatatacgaacatgaaaaccaaaataagatgtcctataagaggcttatatcggaacttgcccatgcacatacctgaatgagaatgatattcgcaccttgcgcatgagcagctctaaccagcctgcagaggaatacagaattcaatattaccaccaatgaaatgcgtactcctagagaagaggttatttgcaatgaatctaaaatggtctgaaactactaggcctgagaagtagcgaaaatatcactgaatcacaaagtagatgcaatagcatatagtttcttaagcacttagcgtttgaataaaaactaccttttttattgatgtttagaaaatcttctctaaaaactaaacacaaagctaatgcttttcttgagggataccacaactcggcatctccttatatagcaaattctcattgaacaaactcctatttctatacgtaatggaaaactactttttttcttttcttaatagaaatagctatgttccttatttagcctatcgtatcctttaaccgacttgttacggatgtcttgagctcgacgttattgaagcttatccaacattctccctcttaagcttcaacttggtcttggaaatgtcttgaactcctatcaagcttctcatctcactaaactttattcgtgccaaagctttagttaagatatccgccttttgttcaactcctggaacatgctccacatctacaagttctctctcgatgcactcccgtatgaaatggtagcgtttatgaatgtgtttacttttaccatgaaatacggggttcttagtgagtgctattgcagacttgttatcaatcttgatgatgactttctcggtcttccatcctgtgatctcacttaataagtcttgaagccaaatggcttgtcttgctccctctgttgctgctatgaactcggcttcacaagacgatagagcaactgtgttctgtttttgagaacaccaagtaattggtgaagatccaaaatagaatatatgacctgtggtgcttcttccatcatcttgatcaatgttgtgactactatcactaaacccatgatttctttgatcctccacgatcaaacttcagcccgaatgcactgttccctttaggtaccgtaggatatgcttaagtatatcaccatgtgacttacgaggattttgcatatatctgctagcaactccaacggaaaatgccaagtctggtcgtgagtgtaagagataccttaagcatcctacgttccttcgataccacgtagagtctatctcttcttcatcttgtgcctttgaaaccttcagtccgaactccatgggaacttgagttggattgcatgtttctaagccagcttctctcaagatctttcttgcataaccttcttgttttatttcgatcccatctttggtttgcatcacttctattccgagatagtaagtgagtttcccgagatccgacatttcaaactttgttgacatcccaatcttgaattctcttatgaccttgagtgtattgccggtcacaaataggtcatctacgtagattgcaattatgagaagatttcctccttcttccttgcggtacacggatgtttcttttgggcatttgatgaatcccattccctttaggatttgatctaactttgtgttccaagctcgaggagcttgtctcaagccgtacaatgcttttgtaagtttgtacaccttgtgttcttcaccttttacttcaaatccttcaggttgctcaacatacacatcttctcttaattctccatgtaggaacgctgttttcacatctaagtgatgagtttcccatccatgtgatgctgctaacccaaccaacaatcgtatggtctctaaacgtgcaactggtgcgaatacttcatcaaaatctatgccggattcttgtacatatccctttgctacaagtcgagccttgtacttgttgatagtaccatctgcatttttcttgatcttgaaaatccacttgagtccaatcacttttaccccactcggtttatcagttagattccatgtcttgtttttgttgattgaactaatctcttctacgcatgcttgtctccactttaataaattctttgcttctttgtaacaccttggctcatcatttattgacagtagaagtttctcacattctactgctgcttgaaggacataatcattaagataaccaggttgagtgacttgacgcgttgatcttcttagtggttgctcctcattctcttgttgatcatccatattgttgtcacctccttgttcatgatgattttcgtcatcattggactcattactttcggtttcatcatgatcttgatgttgattgtttccgattacagtaggtccgtctcctgcatcaacaacttcaccccatctgacataaaacatccccggatccctgcttggtccatcttttgtttcattccaattccaactagtcttctcatcaaacaccacattgcgacttactataacctttcgtgttgttggattatagagtctatatgccttggatcctggctcaatcccaagatgcaccaatggttttgatctgtcatctaacttcttgagatttgcgggttcaacctttgagtgagctagacacccgaaaactcttaaatgtgctaggttcggtttcttctctcgcaagcattcgtacggggtcatgttctcaagtgctcttgttggtactctgttgattacgtatgtagaatggcgtattgcttctccccataagtagtttggtaccttcattgccttgagaatgctccttgtcatctctaacaaggtcctatttcttctctccaccacaccgttttgctgcggtgtgtatgatgctgtgagatgtcttctgatcccactttcttcacaaaactcattgaactctcttgaagtgaactcacctcctctatcagttctaagagttatgattgatttaccaagatctttctctactaaacctttaaacgccttgaacctaccaaatgcttcactcttctctttcatcaagatagtccacatgtatcttgaaaaatcatctatgataacaaatatgtatttgttatgcgcactggttggtggtgttataggtccgcacaagtctgcgtggagtagttctaaaggttcagatgctcggaacatggttgtcttgggaaatggttgacgactttgttttccaaccaaacacgactcgcacagccttttttcttctctaattttcggcaggccatgaaccatctcttgtttggacatagcattgattgttttaaagcttatatgtcctaaccttgcatgccacctccatgtatcatctcctattctcgtgtgtaagcatattggttctccgatcttcagacttgtcttgtagagacgatttggtgctcttttaacttttaccagcagtctccctcttgaatcatgaagcgttaagtaatcttctttcatccttacatcacacccgacttccgtagcttgtcctaaacttaggatgttgctcttgagtgcgggaatgtaatagatgtctgtaacaagtttttgctcatcggttttgctttgaaacaggattgatcccttccctcctatttcaacgcacgatccatctccgaactttaccttgccctttatgttctcgttgagctccgaaaagaacgtcttgttaccagtcatgtggttactagctccattatcaagataccaaactccttcttccttcttgttggtatcgtagttcgttggtattattctctcttcattcaaaaacacaatttcatgcatataaagtgctatctcagcttcttctgtctccactttatttgcttcttgcgtcctttgtgtcctctccggacatacggaggcgaagtggccagacttgtcacaacgataacaaattatttttgatctatccttcttttctttccctcggctttgatcactgtgatttgtttctcgttcttgtgtgttggtccttcctctgcctcgtcccttgtttcctcttcctcctcttccacgtcctcttcctcgtgacgacgtagaactgtgatcttcggagtttgagtataacagtttgttttgcgtttctccatggttctcctcatcaacaatacgttcttcataggcctttagtcttccaacaatatcttcaaattccgtagattttaaatctagaatctgttcgagggctgctatgatatgaatgtacttgcttcttggtagaccattgagaaatttcttcacaagtttggttttctcaatcgtttgtccaagtgaggctgatttagatgcaatctcggataactttcccacaaagttatctattgtatccgtgtcattcatcttaactctctcaaactctgatattagggtttggagccttgcttccttgacacgatcagcacctagatgacgagatttaattgcatcccatatctcctttgaggtctctctctcaccgacttgtaagacaagagactccgggattgcttgaaacaataatccaatggcgatattgtttttatctgcatctgccgttccaggttcgattgtgtcccaaactttatatatcttcatcaacaccttcattctcatggcccataccgtataatttgtggcgtttagtataggacattgaattgacgaaggcgtgaattcttttggccgtgttgcgacgtcgtctcccatagttcggttacgacgagaatacgttcgtatgatcttcgtattggtgtttaacgagaggctgttaggatcgacttatcctgcagctctgataccaaatatagtttcttaagcacttagcgtttgaataaaaactaccttttttattgatgtttagaaaatcttctctaaaaactaaacacaaagctaatgcttttcttgagggataccacaactcggcatctccttatatagcaaattctaattgaacaaactcctatttctatacgtaatggaaaactactttttttcttttcttaatagaaatagctatgttccttatttagcctatcgtatcctttaaccgacttgttacggatgtcttgagctcgacgttattgaagcttatccaacatagcagagatggtatgcagctaattttccaacttgaagagctaaaacacaaagtaaagacttgaggcaatgaaagaaagctaagtagatggagatatcaaagcatcacagaaaaatgaccagaagaaaaacaggactccgaatttgattatgggttgtcccaaaggtaatagcaaaggcaatttctttgacgttttcaccataatatatttgtacaagcaaataaattgagaaatgattaaaatcttagaacagcacttagaaaaaaaaaaaggagaagcaacgcagtgatgaacatgttgtgagaaaaaggctctacctttcggcggtggcgagattggtggagagatcatcggtgcaagcgaattggagagctgaaacaacaacctctctggaatttccgttctccatcgcaaaatgagaatattgattgtatatgaggagaggcggttgacggccgattgagcagctgcagaaagggcgaggaaagcaatctctgcttctctactatttgtagctacaatacagtacaagcaagttgcgatgagctccggattgggcgggtgacctgtaaactttgactactgcgaccaaacttttttctttttaacaagaaaataaagtttttttatcatgtctttgtatgaaatcaataaataaatgacttatagctgaaataataagtaattttacgattttactatttgtatcaattaattttgcttgattttcagttaatattagttagattaatttttgtgtgatataattattaataagatacaattctaatgggaaatgattagagaaatggagaaagtgggaaatgtcacataacataacaagtgagactaataaataaaattctaagcaacaaagacatcaagctgcgacttattttcctgatcgatgacatcaagaaaaacaggatcaacggtggtatgactgtccacgtggaccttaaacttatggtcccaccacagcaccttagccgctccttcaatgtcaaccttagcgtccaacagcatctgtctcttcgccacgtcactgaaaaacttcgaagcatggtgagccagctgaagcccgtccagccgagcctggaggcggagcaacttacaggacctagccggctgagagccggcctcgacctgagcagagccgagaagagaaccgtcgtagaagatggacatggaggtggaggagtagtggattgaggtgatgttaggattggtgacgtggacagtgaggagaaggtcggcgtcgaggacggggagattgagcttgaaggaggtaaagctgattgaaattaaatggaaagtcgggtcttttggctttgcgttgagaagagctgttactgctgtagctgatgctgctccgatcaaagcggagctccagctccattttaccttcttgctcgtcatcactctatttctttagatttaatttaatttaaaatctaattctattttattttatttttggggattgttgcagaggagaagagatgatagtatagcggcggtggaggtcaagttaggaggagaattcggcgtttctgaagaagacacaattactccgggagtgtattttgacaggtttcacgtggtggactgcctgcctctctgaaattacaagcaggccgacgaggacaaccaaaaacaataacgtgcctatcgctaacatatattattttaaaaataatcctactattgttttatttaacatgaaatatatttattatgttttaagttattcacccaataataagattattaagttataaatttcattcgcatcaaatttatatttaaaatctatttgagatttattgagtgattctaaataattttgttacatttaattcctttacaaatttataataatgttattatttcttataattataaggagttataatattataaaatatatatttattatgtagaatcaataattaatagaatttttcaataaatttatgagaaaatctatcatgataaaagattatatgctattttacaaaattatcattttttatctctcttttcataaattaaataatttttttggtattatttatcatcatcaaaagcactcatttaaaataataatttttcggattagggtcggggcgggtagggtaaagtttgtaatccctgcttcttttccctaccagtgtgtaagcgaaccatagccatcaatggcagcgatcaaagcaagtctgcgtgtaccagcccccctttctcatctctctcctaccttcctcagatccttctcttcttctattactacttcttcttcttcttcttcaataatctcacaatcacagcatcttgaagaagattacataaacccctccctatcattcgaagaaactacactagcaaacaaatttcactctctaatcaaagaccaccaccggagaaacccaaacttttccttacccaatactccttctcactctctctcccttgacttctcccatttctccacctcccctgtctccccctccctcgtcagtcacgttatcgaaaaatgcgctgccgttcgccacggcatcccattcttccaagccctttcattcttcaactgggccacttctcggcccggcttcacccaccaccctgagccttacaacgaaatgatcgatcttgctggtaaagttcgaaactttgatttgggttggcaagtaattgatttaatgaaagctagaaatgtcgaaattagtattgaaactttttctattcttattcgacgttatgtcagagctggattggcttcggaagctgtacatgctttcaatcgtatggaggattataattgtaagcctgataaaattgccttttcgattttaattagtattttgtgtaggaaacgaagggctactgaagctcagtctttttttgatagcttaaaagataagtttgagcctgatgttatcgtgtatactaatcttgttcgtgggtggtgtcgagctggaaatataccggaggctgagagggtttttacggaaatgaaagttgctggttgtatgccaaatgtgtatacatacactattgttattgacgctttatgtagatgtgggcaaattacccgtgctcatgatgtttttgctgagatgcttgatgtgggttgtgagccgaattcgattacttttaataatttgcttagggttcatgttaaagctggtagaactgagaaggttctgcaagtgtataatcaaatgaagaggatggggtgccctcccgatacggttacttataattttcttatagagagtcactgtaaagatgggaatcttgatgaagctttgaaggtgcttaattcgatggttaagaaagggtgcagccctaatgcttctactttcaatggtttatttgggtccattgcaaagttgcgagatgtgaatggtgctcataggttgtatgctaagatgaaggagttgaagtgtaaggccaatactgtgacatacaatatcctgatgcgaatgtttgttgatacgaaatccactgacatggttctcaagttgaagaaggaaatggatgaggatgatgttgaacctaatgtgaatacctactgtgttttgattgcaatgtattgtggaatggggcactggaataatgcatacaagttcttcagagagatggttgaagagaagtgcttgaaaccgagtctccctgtttatgagaaggttctgcagcagctcaggaaagcagggcagttaaagaagcatgaagaattggtggcagttatggttgatagaggatttgctacccgtcctttataaaagaagccatgtcttctgcacctattagctgaattaggtgatttttatttccatttgtagcttagtatacagatatgtgtttttgtgattttaaggccggagcctttatataatgtccgttttcatcatgcagcagagagcgtataaaattaaatgccattcagcatttatcaatttggcaactcttaccaaaaaaatagaaaaattgaattctcaatcccaaccctgatatatctttgagggctctgattaaggaatccaaatatggaagttctatgaaattgatgcttgcattgtcatctccagccaaaagttgctcttatcgcccttttaaaactctctcttgatataggactctatcacaggttaaaattgtgtccggcacgcactaattatgttaaaaaaaaaggctcaaaaatgcagcatttggagatacagtagagtgaacatagagcgagccaaccctcacttccctcggaaaagctaagcagctatcctatgatgcgaatcttttaaactcggaagaacaacagcttttaacttattgatctacacgataacagtactaaataatgctcgtgtttttcaggtcttgtcttggataagaccaaacactgtaagaaggaagtttacagtcagaggaagcaacctctaacgaatgcaccagcgaacttgaatacttgctgaccgttctccacgttgtttcgtttctcgatggatttagagagtaatatatacatatccttactcacgcctaatcaacaccgtcctagttatcagattcatcaaaatatgtgatctcaacggttcaaattatctcatatcacttcaatgatttttatgcacgtgcctgttactcagcaggacgaaacaggtaaacaacttgcagaaggaaaccgcctttataaaatctttgatcttctctaacaatacaaaactaaactcaattctttgatcagtatatccattaatacttatcacctctttcgttttctcttctttttatcttttctcgaataatggattcttatggtagaaaaccttcatctagccactcctatgccccctctgcaccatccttgcccgagcaacaaggccacccctacagcagctctcctccttcttcttcaagtgacttcaggcggcagcagcagcaataccagcagccgcctccttacggagctggatatgggcagtctggatattcacatgggtactctgattttccagcaggaacacacccagatgtgattaggagcttccagatggtggatagagacagaagtgggtttattgatgaaaatgaattgcaacaagctctctcctctggttatcatcggtttcatattaggactattagacttctcatgtttctcttcaagaaccctcatgatcctctgcgaattggtgagttttacaattttttttttaatttcaggtcaatctcaagcttactacttgattggatcgcatactttcttcttatacatctgaaaatttatattcttgacactggaaatttttctttgtgaaaaggaaaaaaaattgttatttctttgcttggatttcaaagaattaattctccagttcggattctatatcttggaatatgcttgtgtttcttcatgtatttcgatgattttgacttccaaatgcattttgcttttagctaggtacaaaaagtaaaacataaaagctatgagctttacctttgagttacattgatatattcaaatttgctaactttcactttcatgtttttggtatgaaataattaaataataatgatgtcggctgtactttttataatgcagggcccaaagagtttactgctttatggagttgtttgggtcaatggcgggtcagtagtctctgatttttcctatatagttaccccttctttttgaatgtgaaagatgaaactatcattctgtttctccaattctatgtagaaattcagttatcagtattttcattctcttcattgctttaaccaccaggagcttgaagggcactaatttatgttagggaaatttattagaaattcatttgcagaatctgcctgccctgtttagcttcaataatcaataatttggtattgtcatagaatttgcttagctctactgatatgggcagaaaaattatgtacctgttaactagcataatccctttttgtaattctggacaatataagttctgcttacccccgccccccgtcttttgaatctagaacagaaattgtctgtaattgcaacataattatcacataattgttagtcattatatagctatgagaactagtgcttattattgtaacttttctttgatgtacctcaaacatgctatttccttgtgctaattataaaccatgcttcttttagttgttaaaagatgagttcttcaatttatctttcaggggatatttgagagatatgataaagacaggagtgggaaaatcgatttgtttgaactgagggatgctctctatggcattgggtatgcaatccctccttctgttcttaaaattctgatttccaagtatgatgatggaagtggcaacaagattgaactcaattttgacagttttgttgagtaagttttctctttagttctaaacctcacttctgcatgaaaatgtaatttagagggatcttaaatctgatgacatttctgctgttttcttttgtttttgacttgcagatgcggcatgatattgaaggtgagatcataacttcaagctcttgtgatattctccttttcaacttattttaccttattaattttgtcactaggtagaaatggtgctatgtgaaacatgaacacactattatagaatgcagtcatgatcgatccttttacctccttcgcactgtttattctgatgatcatgctcttaattttttcattttcttcccatggttatcagggtttgactgaaaaatttaagcagaaggattcacgttatactgggactgcaacattcaactacgatgaatttatgtctatggtcattccttttcttgtatcatatgattgatcgcggaactcctcatgtaattaccttctcttgtgtggtctttttctgctttgtcaccctccagatttgtagtcattaaattattttgtttggtgcttgagaagattttgtccttttgggttcagtttattatttttgtaagaatgtgaatagaactttttttctttttttggttacatatgtgaatagaaatttgattgtctgtcaactacgactaattctgaaccttttcaacatgtgtttaatatttatttttaagagaatcttcactacatttctggtgtttttgttctgtttgacttatatgtttgtgaaggtcagacaataagttcaaacttctgatgttttcaacttacaggattaaaacataatcagttcttacatatacacgcatatatagataaacacattggcattagttgttctgatacgtttgaaagtgggttgtaacttgtaaaccccatatcgaaatgaaatgtgaattatattctgaaacttgttttttctcatcaagttctcaagctattgaaacactgctagcagcagggtaaagaaaagaaaaagaataccacacatcagaatctagttgtggtagcatcctggactttcatagaaaaccgcaagctgcctatgcaaaatattgaacaaaactaacaagcaaaactgcaagaacccaaaaacttgaaccagcatacttgtgggtgccttcattagtaccatggtgatgacctctagccccagtagcagcatatagtggaactacagttgcaccattcttgtatgccccatcattattccctgattgccctccgctgatagccctgtctccttgtccgccagcatgacctcctcttccgtgaccaccaccacctttcctgtttactgatatcaaccgcttgagccctattataactgttaagtttctctgcatctctttgtccgcagcatttggttcttcctgaaaggctggaaaggtggcaccatgttaaaatgacaagttaacaaatgcttccgaattcatgatatctgcagtcacatatagccagccgcatgggaattaggatcatttgcttatgcaaatgcaatcctcttttagttttcaacttctctagtaatatgatcactaaaagcatcatccttgctcttttttcttttctcaaaatttatcatgcaagtaaagacatgcatcagtcattattatgctttaagcactccaatattgtcgatgggaaaaggtaaatataacgtcaatatgatgaaagaagattctttcttaatcagagaatgccaagtattttgatcacctttatcaggctgattcgtaaaggtggatcagtgagttggacgaagaaagtttataaaaaatgatgggcagggaccggtttggattggattggtctggtaacctcaagatgtgtaattgtaagggaatccttaggattaaaggtaaagctggtgattacgcattaaagggataaagggcaatgtcctaatcttgaagatttggcaaagtttgcttcttggaatcgtattctttcaaataaagaatattcttttctaaattgttaaatagaattagtgtgccacgtaatttgtaagcaaaactaatattagatgtagcatttgaattggttgataattgattttgactgtgaattatgtggtagactaaatctatctaaacgtctctcattattatgaaaaaattacttgtgcttgtgcactatttgggaaaattttgatcgaggttggctcttggtttgcactttcttcagtgaaaactattgatagcaactcatgatcagttcaggtagcttgtataagtatctattgaatcactcttaatgatcagtaaaactaggggcaaccttgaacgcacatacatatatacatatacaaacacatatgatgcttttcaatggagaataagagcaaaacaaaagtgatgaaatacactgaaactgaatatgaatgtagaaacatgcagaacttataaaactaaggaggaagtagaaggtaaaacaaataataatatacttgaagaaagaaatgaaaataaagaaaaacaccaagtatgggaaagttatataccagttgtagtattgaaaggatgtgcatgcaaaagagggagatgaggcagcggcaacaagagtattactaaaaggaaaaacctcaaccctagtttcttgaactccattttcatctgtccttgtgtaattccaatggaaagtaaacttgcctttatatatatatatatatataatgatcgacacggcatctgtgcttatttggttttgaaggaaaaaagaaaagattgaaatggaaatgggaatttaattctattctattcctttttcttttttctgtatctataagttggtgaaagtataatacaatcagtaaatttcttttctcacatatcacaaaatagatatccacagttaaataatttcttatttgtacttagtaaatttattttgctcaaacttaaaagtaaattcataataaagctaaaatgtaatttggaaacatgtgtaatattattgagatttccttttcctgaacttttcactaatttgtatcaccaatatttaatatatatgaattatataaaacgagtctaagatcttaattaggacaacaactcaagtctcccctttcccttttaattaatcctaaaatcaaacacatgctgacaggatagcaccttttttgttggctgaatggtgaaataacactggatatcccacttacactgttcgtgcaccccatttcagttttctcatggaaggtaagcctttcgccattactgatgtttattacgtacctagctctctctctctctctctatatatatatatatatggaaatgagataacttccttctttccatgtccatcaagtagctagctagctctaattctaaaatggaagatcatgaacatgatgataagtagagcagtggcattgacagtgacactattccttgtccttatttctgtgaacttgacaggccagtgctatggtcaactgcaatttgggtactataaggataggtgtttgttcgatgttgagtccatcgtgcgcggtgtagttcgggcaaaattcagcactgacaagatgactgtcgctgctcttcttcggttgcagttccatgattgttttgttcatgtatgtaagaggctatgatgttattgatgctgcaaaatctgctgtggaattcttctgcccgaggcttgtcccttgtgctgatattattgcaatggctaccagagatgctgttctcttcgtaagttgcatcattttggagggtcatgtgacctcgaacagtgattataatgttttatcatacttgcaggcagacggaggatggtacaatgtagaaacaggaagaagagatggtttggtatcatctgctaaagatgtggacctgcaatttgttaagaaaggacttctaggtacttcaaattcttcctctagtaatattggtttctcttttatctatttgttttttctttgtaacatgtaggtggtcacacagttggtgcagcgcattgctccctcttccaaaaccgtctatacgatttcaaaaatggcctacctgattcaaccatggatagaagattactcggattctaagagataggtgtcctcagaattcagctggaaccaatacaacatttcttgatcagaacccttctagttctttcattgtagataattctttctaccagcaaatactacagctgaaagggatcctccaagttgatcaagaactggcattgaaccccattaccaaatccgtagtgaaaaatatagccacgggtaatgatttctcaatcaactttggtcgggccatggtgaagttgggagctgtagaagtcctcactggcaatcaaggggaaatcaggagatcatgtgtaacagtaaacaatccatagaacctatcattgtatcagttctactaatcagtttgtcattcatcaatatattgtatttgtttcttttccttttcagattcatctctgtatatgcactagtccaagaatagatataacagtgtcaaggttatattaaccaatatgcgacaagaaaatatcattaacaatgcttcaccagaagttacacggatcaaatgggaactgctgattcaggaaaatacgtctgccagtcggctggaataatatgaattaaccgcgttgtccgcaagttggtactctgtaatctttatctttgactatggctgcaatgtcctaagtttcttcatcaacttgtttactcaaggaaatagatagagcttgcactagctaattgagtttaattcctgacagtcgcaatgtcgtcccttttatttcttcatgtttgagaaaacaagaaactttcttatttattgcaatcaatcctctaaaacaaaaccattccgcgtctcaattttactaattttttagttttcgttcttgtgtatgcctgctctagtttgtcagataactgcaactacaacaaagttacattgtaatcaccatctgtagttatcatcgaagaggcctgcagaaaggctacagcaaaacttgccttctgtacgttgctttctgctctaaacatatatatatagggatatatctttgagaattaaacgcatctatcattacagcatccataaactcttatcatcatcttcacagcaagctgttgattcttgaccatggctttggcaacttccaccgttaaattcttctcactactattttcgtcatttgccattgttcaactggcaatggcaggagatcctgacattgtttctgacttcgttattccatcaaatgtgactgcagttgatggttcattctttacattcactggcatgcgtgcccttgttggtgctgcaccacctacagctttaaaagtcttgaaagctggcatggcggaattccctgctctgattggccagagtgtttcatacgctgttcttcagtatcctgccggtactcctaacccgcctcacacccaccctcgctccgctgagctgcttttccttatccaagggtctctccaagtaggattcgttgacaccaccagcaagctcttcacccagacacttcaacctggtgacttgtttgtattcccaaagggacttgttcatttccaatacaatgcagatgcaaagaaccccgctcttgcagtttctgcttttggaagtgcaaatgctggaaccatatctcttcccggcactcttttcgccaccggcattgacaataacatcttggctacatccttcaagactgacgttgccaccattcaggctctaaaggttggccttgcacccaagccatgaacgttagactgccttatcattacttagaatatccactattttgcgctgtcttttcttcttcctcattttcttagtttatgccttgagtgttgattaaccaactacaccaagggctcacagtcacagtcaaagtcacagtcacagtcacagtcatgctcatgggtagaaattctttactttttatatttttattgtgttgtttaattatctccaatcgttggaaatttacgagtgatcgcttattttagtctgtttctggaatcttcacctctatacattttttttattgcatcgcctgaatttagatataaaacagccaactcgttaatcaacaattgacacccaacatttatgcaatccaacttgatacaccatttttgatttaaaaatcttatttcatcaccaataactgacctttatatactttttctttcgaggaaagcgtaaatgaataataggtcgagttcacatctccattcccttttgaaaagctttcaagatattatcacaaacggttgaataaaactacagcactatatccgaagcaaatcctacacattgaattaatctataatagcaactctatagaccaagtaagtattgagaacaccaaatccacatgcatttcagggagatccaaatagaacccacgagccatgaggcacaattatttactacgccagacatatcatatacttcccacgactaattaactttgcagacatgcatagtattagtaaaacatatgtaaaatactgataagtaccgacaactgaagatcataatattgtgattctgaacatcacctgaaagaaaattcatactaacgtatcattatgtttctacaaaagcttaaatatcaattccaggtagattaaaccagagaaaaaaactacaaaaatggcgcaaacttcaaaaatccagatccaggcagacctaaaatggtagtgaatgcgactatcgaagcaccaatacccacaaactggaatagtttgaaaacattttacagccttcttccccttctaccaccctttctgcgagtgctgtcagtaggaattggtgtcacgtcctctgaaaacacaggcatcaattaaaatcaattcagcagattcactacaatggaacttcaagttcccaaactgaaataaaaattataactcaccaatgcgaccaattttcattccagaacgagcaagtgcccttagggctgactgggcaccaggaccaggtgttttggttttgttccctcctgtagcacggagcttaatatgaagagcagtaattccaagttcctgttaatttaaaagcaagattcagtcgagagtgagatccatgatatgattaaaaggaaaaaccatcatactaaacatacttttcctaaagttataagaatcaaatataaagtacgccaacaaccttgcatctctgagtaacatcctgtgccgcaagcatggcagcatatggtgaagattcatccctgtcagctttaactttcattccacctataacaacaaaatacaatactcagaacgctacccgttttctaaatgaaggtagcaccaaatccttttttttaatagcattcaaatgcagcagcaaaatgagctagcattaaatccaaacacatattacaaacttaatgtcaccttgaggaaaagctccttgcattaagatgttctctggcttgaatttcataaggttatttctaaatagttaacagcatataattgtttgatcaagttacatcaaagaacattgagaaactctcaagctactatcatttatcaataaaagagaggagggagcacatgctataacaagtgcatgtagatcctctgtatccctacagagagggccaaactagaaaataagatatgacgacacataccagtaatgcgaaccatagtttctctaccggacaaatcagtgacatgctgcaattataaaaaagtacacaagtcatacttaatacacgtataaaaggtatctcgaaaggctaagcattgattcaaattaacaaaattacttacaatgaaagtgtcgttaaaagaagcataaatatgggccactccaaaaacatgttctccttctcttatagcaggaccaagggtgacattttcttcctttggctctcttgtcttcttcttcgactacagtatcattgccaatggaacaaatttgtgtaaaaaatatgaactttttgagataaagaccgaatgcgccaacaataattatcaaatggcaagcaatttcaaggaaaagacatacatggcgtaattccagttctctgatcatacactatgaagaacaaataaatattccataattctacagcctaatgttaaacacacttgaaataattcattcccacactgttttcagtctccactacttatctatttaatttaacttcaaaagcgacagatcctcaagaaagacactgatttgagcgacaatacaaaacaataatcagccaatctgataagtcttaaatccttaaatctgatcaacagcatcaaaatatatacacaactgaactatcttcgaaaaagctaatacagtccatataactgacgaagagctgaattaattcagagataaagaaagaataaatgcaaataatgaaattagttagaattcagcttaccatggcttcgagggttttatattatttgatcagagtatacgctgagagatgctaccggattgtattaccagtggctgtcaaatggccttgctaacttctatcactcggctttatatctcgccgactgcgattagggttttagtttttcttatttatcaactgccccttcaactttagcgttatttccctagagccgttactttttatgacaacttgtggccctggccttcgatccaatatatagcaactatgttttctattgttatcatgggctttatagtgggctgcccataaaaattattatcaaattctattattcgaatttttcatgctaattcaataaattttataaaaattaatattcaacatagtaatcttaatattatttatgttgctgtctatatgattttagttattaatattaaaattcttatagaagtaaagtaaaattatactcaatatcaagtcaattaataaatagttaattgatatggtaatcatagatgtaatttgtttgtttatgactaatgatgtaagaagtaaataaattaagcaataatattactgagggttaaatttgggggtgtaattatacagtacagatgatgtactgaattaagcagtgtcaattactataatgtttcttaaatcagtccaaatcttttctcaaaagaaaccgactgccttttcttactctcacacgtttatatcatttccacccaaatccaaccgttaaccttttctaaatttaactggaacatcatacagccgacggccacgatctctcttaatcttctttgccacgtcactctactttggtttctagattccctttcctcaaaaagtacattctttttccatgataaccacagattccgcgaaaattataacagctttaatacccgacccgacttttacttttgatcatggatattaacggaccctcccgttttcgccaccggaaaacgccgtccactgacagattcttagccgcatatccacggacatctgaacaggcttcctcggccgctgttaacacagcagatattgaagagaatgagctcaacgaagacgatatattctccactggagacttctccgaagcatctaacaaccaccgccaccatcaccaaaccaatagtcctccctcctccacctcctcacctcggagtaaaccggcgtttggtcacctggattcttttggcatcttagcggccctcccggagcataaaaataagcctcatggctatttgtatcagaaaacagcgatttcggcagcatctacgtcgtcctcgcgttttattccgaaaccgccgcaagaaagattgccaataaattcgggttcacatcaacagccgcagtcagcgccggtgaatgtgccggcgatggcgatgaggatgaggccgaaggattttgatgagatagatgaggatgatgatgaaggagatggagagatgcttccgccgcatgagatagtggcgagggcacagtctccgatgttggcatgttcggtgttggaaggtgttggaaggacgcttaaaggaagagatcttagacaggtaagaaatgccatttggaggagaactggctttcttgattgatttgactgactgattaattgataattttgagggctttctcttttacagttattgctctctttttttctttcttagttttgctgttataactatttgtggaaaattcaggtaattgaaattgggtgttcaggtttttctggagggcaaatcgtgcttcaactcatgaattgtttcttcttttaaaggtctttttgtttgattggtaaaaaatggtactttgactagtattgttaattctaatttttcttgaaaaattcaaagattgatagagagggtgtgcagtttagcatatttaggattaagaatttagttgcttcttcagtatcactaaagttatatcattctgcactcacaaaatggaatgagatacatattgttttgaaggatcaagtgctgcggcctgcagcaggagtttaaaaagataagtcgtttaaactgttagataggaaagaaaagagtggttaggaacaagtgcttttttagccttctgcggagacgataaaagaatttgtatttgtgtcttgaaaagaaaagtatataagagtttttaaatatatatatcttatataccagctttgagaagaaaatacgaagggtctaaatctttgacttatattcctgttttcatgtctattatcattaaaaatgtgaagctcaagtaaagtcgacggattcctcaatagtaatcttaggcctaatgatccttcaaatttttgtcagtgcttgtactattcatcaaggactatgtcaacgttataagggcgtgctgttattctattggcagacttcaaattgcctagctttattcacaatatgtggagaagattagagttcgtaaatgccattggataaattttagttttcattgtaccgacccttaatgaaaattggtttcaataacctatggttggaagtctccagacatgactttgctgtatttctttccaccataggtattggtttcaagcataaaacagtgggaagcttcctgatagatttgttgagatggcaaaaattgcaatcaactaacttaggcgtgctaaggtcctgttaatcatcttaagaaaaaatgattctctggaaatgctgttaaggtttacttttatcaaaggtctatacaatctttcttaagttcattcagataggaagttctcgcttttgaatattgtctttgatctccttgtccaaagttatccatgccacttagttgttctatgtcgggcagtccctagcaaatgcaatagtttgctttggttgaccaaggttgtaaatagcttttggttcttttgttgctataatgaaaatgcaagaccttgtagttcaacataatatatttctttgacaatttgtggaagtaaggaagtgatgcctgatactctcaaatcctatggctgtaaaagacatcttctaagcatcctatgcactaataggttatttgagataccaatttcggtggcttgttttttctttttgcttggtcatgaacttgtataatcactatgacttgaagggtggaattgtggtggaagagaataactactgtaatgagttgcctgagaattctcaaattagctggcaacttgtaaaagatgcaagtcaccatcagccagcagtagaagttcttaccactattttctggatgtttccagccttgttgcgtccctgctagttaggtggcgccttctgtattaatggcaatgcttgtctcttacaactacaagatgtgaattacttacgtgagtccaggttaatagggagagcactctactctaattcacacagggaaaaatgaaaatgatgtgtcaatcaatcataagatagaaagactaaatgcatgtgttctctccagtaatagtaatggtagtgccaattgtgttttatctgttaaacaatatctgtgacctcagaagcacaacaatcttgcaagagcctgaacacatgcagttaaatccgcaaaaccttaaaaacttagcagcttgcctataacaaaagattcttctgtaatccatttacaatacccccacccctaaaagctaaaaaaagcttgatgaaaatttgttaaagttgttctccagcttctagtgatggcttaattgggtagtcctactacatcaactgaagtggatgcttcttagtgatcatccccacaacacaaccagaaaatcctgcatctcttaaattgccaagtttttggttgtcgctggggagaagttgtctgtttagtatattatgttatattatattataggcctaatgacattaaaaattcaaacctttatgtccaattgcgaatttggtcaatccttttagtttttatttaaatagcatgatttagctaattaattgtaattatagtaaaattaaaatttcaatcaaaataggacgatgtgtcattatcaacaatttacatattacagttttatatatttatacatggcacacaagttaccaaagttaggttatagatgaacatgaaaatgaatgataagtgaaaatcatgaatcaagaaaaaaagagattagtatctagagttaagaaagtatctataattaatttgactataattataattaattaactaagtagggataatttgtaaaaagaagacaaatgtttagatttttaatgtgattagacatatattatatggtctgacaacacagcaatgcttaaaaagataagcaaagatgcactcccagattaaaaggatctgcgggacagtcctgataaacaataattccgaagttgccattttttacttactattgattattggtcttgcaagtattattaacatttcttttatctcctgcttcacgaaaactatcttttagttttagggatttcaataagaagaataaattatctttatctttgttactatttgacattgatttttatgccacatgacctataatagtgttatatggttggcacttgggagccacataaatagctttgtaaatagccgcatagataacatttatcaaatttttttctatcttatagcgatttgtgcacgatagtgtgacatataagattaagttaaaattgaagtaaagttagactgaaatagattggatttagatttaatctaaaacgtgttaggtagaatcttaacgggtgataaagtattttcttgacagtcagtaagaactcgaaatagattattttggacataaataaaaagtatgtaaattaaaagaaaaaaagattatattttttagaacattgtcgtataaaatatgatttccttctttgttttgttttgctaaagaataaatgaggcgtgtccggtgagatagggaaagtaagattcttgaagaagtagtaaaagagaagaaaatagatgtggcagagacaaccataattggaggtggtggtggtggtgttggtttctgtattaaaagctgccctaaggaaacccattgaaatcaatggttgcaacttgcacttgttaattttgttctttaatattggaatgccatttatagtatagagaggataccattacctaacattgtacaaacatcttaaatgctatgaacaattaaaaacaaaaaaaaaaaaaaaaaaaaaacttttggagcttttttctttccttagggccgaatgacctatccttgcggccggtttgttttttgttaagaaaatatcctctccaacgtaatgatacaaacaaattctttattacaatggtgatatcattaagtaaagcaatagtcctcttcatccttcacccaacaatagaattaaccctattcacgaattagtatttatatgaacatggtgttagggatataaaactatcatcggacttagttcataacggcttagatttttgaatgacgatatcagagtctctataatatttaaaaaatatgtacaatctcatttaggattacaatagagatataaagctaattttatattctcatttaacagtttgcggatggtgtttcggtttcttcagtcatgtgtctactaccactagatattatgatatttacaaaggaaaatcacagccaactatttaacaaaagactaaatggataagcaagctctgtgaactccattaatgaaaagtagttgttggcgctagtgtcatcgatcggaattatcaaatgggcagtgcaaattataagtgaaattctcgttggatgcttcatctgtcaggagggaggactgaccttaataaaagaaatatgttgactggcaattctatcttcacggatgtacagaagtaaaattaattgcacctacatttatacacaccagctactgcccttggcattgggaccggccatttattaaatatgctgcctttcgatgctctgcttatttataagccgctccatccccatctgtttttcatacagagttctatttggcttccatggcttccactcctgctgttgttgtgttgctctttgctttgtctctttcagggattcaattctccacatcccaagtcctcaaagccaaggtttcatgccttgattgcactgcccattatgacttctcaggtcgctccttataactcttaacatattttcatgtttctttactacaaactgcaatgcctttctattagtattactccactcataagttcagggttttctttctttttcaagaacccttcttagatattgcacaaaatggtctatgttagcttgtgtagtttgtaaatggacaaattgataatgatgttatttttcttgtctgcgacagtagctgtggcaattttgtataatgttttcacattattgagaaattcttaggcaacaattaataaataaaacttatgtcactatacaattaatttagtctaccctaagagtttttatacattttaatgcatcaaagttatataattggtttgattagtataatcagactaattttaaataatatataaataaaatatttatcattctttatagtgaatataactatattaaataagacaaataataatgacacttttattgtatctttacggtgttaggatattttttattaaaaaatattaaacattttatttttatttattccgatctagtaaataatattttttaatatgttaaaatcaataaataattttataaaagtatcatatgctaaaagacaacattactctttctcattttaaagtcaagggatagcattaaagtgaagagatagcattactctttcttatcttattatatcataacttaacattattgccgtattgatacctttaaatagaaaagtagttaagaaatattataatttattgataaataaaacacatatttctatgatatgattgtattcataaaattaaggttcaatattcttaaagattttatttttagttgattaagaagttatatcaagagaaacttttaagtattagatttggactcttagcattattcgtacttttaaaatatttatagaatcaatgaaatgttttttttttaaataatcatactaatgaaacaaacaaaaaaattagaaaactgagcaaatataaatacaaaacaaatgaagagagttcaatatattcaaaaaaattctaagactacaaaaatattacataagtaccatttttatttgccttacttgataaatttaaattaattacttctaaggtacttataattccaccacaaaagtaacaaattcttgatgtcccgacccaataagatttaaaccaacgactttctagtgcaagtgccaaattttcattatgggtgccccctttggacctacatgattaattcatttaattaatgtactagcattagttttcaatatggaaaaagtaatatctcctaacatctccattgtccctgtttaactatctgaatttcaggcattaaggttttagtgaagtgtgctaatgtcaagaaattagctacaacgacaacaaaaagtaaagggtcctttgaggttgagcttccttcaggcaattcaaaagctgaaaccccattgaattgcctagccaagcttattggtggtacaagtcagatctatgctacaaggaaaaacatggtctcaaggattgtgaaaaccaaagattcaagctcatacactatctccactcctcttgcattctccactgcattccctgaaggacagctaaaaggtgggattggtgaatcaaagacagttgatctgcctcttccaagggagtggggcttggcaccttctagctactatgtcccatttttccctataattggcatcccatgatttggtatatgcagtaaacttgaagatcaagctattagtagttttgtgtggctttaaattaatgtgaaagggtttggtggttaagcttttcaatatgtttatttttcaattaagtaaagttatatgaaggtttgaagcattgtaatacttaaaatcactgatgatgcatatgtaatatatatggttgcttatagtaaatataatcttttagctatgcttgcattttggcccttcttttctgtttgtgccaacttcagtggccttaattctcttaaatttgagaaactagaccacaccatcattacaaattcagctgctcattcctttaccttccttcttgacccctagactactagattgatgcaaaattgaggcagtaatgactaactaggatgaggaacactagctagcccatgatatcatcccacttctaaatactttaagaaaacaattaaaatgttaagatacgaaatttctttaagatttcatttaatggtttaaaatcttggtgtcttagcttatgcttatgtcttctaatttatgtcattgcttacgcttgtcttaattagataagagcttaattatagtatatgtgtagacttaatttgaagcagtcatatactgacaccttctttttctcttctaaaagtggcaccgaaacagctccctatgattcatgattgtaaatttagaattaatctgtagtgctgactaaggcaaaatgtcaactgaattcacaatttattgattttttaaattagctatcagtgacttagtgggaataatttataactgggtttgatactaagcatgtacacacacttgacctaatctcaatgcttataaaagtcagaccgtgtgatgcaaggagtccaccatcgaaatgaaccgctcttcaaaccatttaaaaaggaattgatctttcttttaattaaaccaaagaaaacttcatcaaactcactaaattttacatgcatgcacttttagagtatccaatttactagtgcaatgaatgacattgaaagaacagctttttgtaacagtcagcgggggaaattaacacatctattacaagttttagtcaaattcatgaccactcgatgcctaaccataacttgccttcaacactgatatatatatatatatatatatatatatatgattgatttgcatttacaagcatgtatgtggaaacccttttctagaagtagaacattttcttcaataacttttgattctgaccgtgtccattttcagtagcacagattggttatttcatgaatttcttagtgttttagttgacttatacaatttatatttgctccatcttgttttctttgtcaaattagtattttctaggaagaggggactcattttgtatgcatgacagaaagatgtttttctggatgaacatatctgactagggtgaaatcttttcatgcatgactcttcgttaaatactaagttttgcatatgctacctgcaaattctttattagcagtgggctactattaagaatcaaacttcaaataatatccttcaatatatcaattaattgaggcatatacaattagtatggagttttaaatctagaaaactgtgtaataagatagtaataaaatatgaaacttgtgtcaaaaataatataagatactaataattttgaagaaagagatgagaaggaaggtgatatagaatatgattgcacatgtaattaagagagaaatataaagaagtatcatatagtttttttttttttttataataataatttttagtatgtatttttatttttagataaaagaagtatatagttatatatcgtgatgaaaataaatactaattaaattctgattcacaaaaattcaactgtattcatttcaatcaacaacattgttatattacccgtgtacgataacatgaatttagaacttaacaacttttaattttgttatttaatcataagatcacaacaaaacaaactaataaattaataagatcgattttttaatggtaaaataacaaaattagacattaagttctaacatcatattatcatatacggatgatatgataatgatggccgatcggcttaaaaataactgaattcctaaaaatcgagattttttaatgatgataaacttatttttgttacaaattgtaacaaggtgctaatttttatctaaaataaaaataaaaatttaaaattgacaaaaaatcttataattttttttcattaagtttaaaatggttcaaatttggagatgccaagaaacaaataaataaaaatcctgaaaagatttaaacacggctaagaaagggtaaaactaaaaccatgagggaaacctgtcgccacaaagaaaatgagtaagtagttatcatatatcatatatcatatatcactttcaaggaaataaaaatgtattctttcttttattcatcaaaagtttaatgagtctgtctatagaaataattatttttaatattgtaagtctacctaacatttattgctattttggatgtctcatatgatattgtcatgtctctttcatttgatcctcttcagcatccgaaaatacgttaacctttttcccaagagcagtcttcactaaaatcattatccattaaacactcttagttttatatgacttcttcaaatattctgtccagcaaggtttcttttcttttctattttttgttaataaacataagacttgagctctatacaacaataataataatactccctccatccaaaaagaatactcttcctttcaatttatacattggataatgttattactttttatcactgtttttctatgctattcttattaaatttctcagaaaagctactatttcaaagtataagatatgaaaattacagttacttattaaattaacaattcaaaaaaattaaggaacgggtcaaaaagagaaaagagattttcttttggatggagagaaaaaataactattaagaaaaatttaagttttgaattttaaatattaaatttctgctttcatatttgtcgttataatttataaaatgattttcaattattgaaaaaaataacattcacaagtaaagaaaatggtatctttatatttttaaatgtagattcctatttaaatctaaagttctaacttattgctaatttatgatatcaatagatattagaattaattataatttatattacagtggtgagtacatttagttgatatatgacaggtaaaattaaagagtaaatagatttttagagtagccaaatagggtaatatgtgcactttatctgcaattctttgtaagaaagtagaggattttataggcacgaaaattgctgaagcattaaaaaagaaaaggaattagagaaagggtaaacaaaatttgaagtaaaacttacatgtatgattcacatataagctattccatggtgtccccaaactgcaatctgagaaaaataaaacattaatgcatataaatgtaaacacctcccaagattaagacattatttacttgcttgctaacaataacaataggacaggaaagtgtctactctaggaagacccagttatccgaccccattgcacgtgtattgacaagcgggtgctatacggacatgagatgttactaaaattattattattttttttttatagccacaattctgaaaaacttattacctttctccacttgcctcgtcatacctgtctctctaaaagtagaaattcttttaaaaacattctaaaaattttaataaaaaatattatttttaagtttatgatgtaattttttaattaatttactcaaacaattaaaattgtaatcttaaaaattaaaaggctgtaagttttatactttaatacaataaaaataaaaaatacagtttaaatttaattaaaaaatataaaaaaagtataagtatttttaatatttttcttaaaaagtaataggatttcacattaaccaatgaataccatagattaagcaattaaacaataaatggttagaatgaattgagaaggagggtgcagctagcaagtggcggggaggcaatacaaaggaaggaaaaagtgactgactcgttcaagatgagttttcattggattagaaatcgtaaatggacgagtgggcagataatttaatgagacaatattttcttctttgtgcaaccgcgtggaagtttctatcaaacctaaacgttgccatttttttctcattttactcggctaacctctccgccactctcttccacaatagagctctctataaatatagatgcacttcccgataacatagacaataatgaaacacaacagcaacaacaacaaaaaacaagaatggaggaactcccgccaggttttcgcttctatcctactgaagaagagctagtttccttttatctgcttaacaagctggaagggaagagacaagaacgactaaaccaagttatcccagcaatcgacatttgcagcacagaaccatgggaactcccaagtatttcttccacccctcaacttgttgtttttatattgataaagctaattgattgactgtttaaacaaaatactagccgtctaagttgaatagtaccttaaagtttgtttcttgaaatgtgttgcagagcttgctggagaactatgtcaaggagacactgagcaatggttcttctttacgccaagacaagaaagagaagcgagaggagggagaccaagccgcactacagcatctggatactggaaggccactggctcacctggttatgtttattcatcggataaccgagtgatcggagtgaaaaaaaccatggttttctataaggggaaagctcctacaggaagaaaaaccaaatggaagatgaatgagtacagagccattgaaggagcgcctgactcatctactactcatgttcctaaggtgttaatcttttgaattttctaccgaaatatgactcaatgatcagtatgctattgatttatgttattgacaataatattttgttcgtcctccattgtttgtgtgtagctaaggtnnnnnnnnnnnnnnnnnnnnnnnnnnnnnnnnnnnnnngtctacgtgatatcggggagctttcgagcattcgatagacgtcccctagaatctacggcaagagagacacaattccttggtggtgatatagctacagcatctgctcaacaccctaggatagtagacaacacaagctcatctgagacttcaaactcaggaggagatcatgctgatgttccgcggatggcagaaagtgccaactgggaggttgatgatttagcaaactctctgtgggaatgggaacaactgagttggccctgattaaaagcacacagagatctgcagcactgcagcatagctctatgtagcttttctaagcttaggataggcaagcatgaatttgcttaattaattttacaggcagtgattagtgaattctttttccttcattgttaggtgagggaggtgaaaataataagaaatttgcaaatttttttacactacacgaaatagatttctgttggaaaaaaagaaaaagaaaaaaaagattgaacttaaaaatatgtaagaatgctcaaaagtaaatgaaagactcggtgtaccagaaggtaagtcattgacgcaatcgactcttaccagtttcaatctaggctgtcgacagcttttagttttggtcagtttcaagatgccgtcattctatatcagtccaattcaacctgtcttgggaaattcaaaagcttaactttgtgaattagaaataaatgaactgcaacaactgaaaaataaagatatacaacgtttacagtcatttatgtcaatctttgaaagaaaaatggaaataaaaaggaagccttacagttatatcattgcgacttttgaaaattaaaagtcagaaaactaaccaggaagtcaagtttatgcttcacgtggactattttaaagactttctaatgctgaatctaagttcatgatggttttatgaacttgaacagtgtgtgtaacacgtatagattcaatgcccttcctctctcaagcatgcagtgcaaattgaaaacgcattaacagatccacacaaaaaaaaaaaaaaaaatcaaatgaagatggatttctattccaactatgttttcaaatctgaagaaactttcattttcgttcttttcttttttattattattcattcactttcattttattactttcatcttttgccacaagtttttgcaccttaaaagtggatcagcgaccaagaggctgctttatgaaaaaggttacgctatttgtcaataaaatgatattaaatgaaggattcggacataattttacttttttgatattgggtcccttttgaattaatatttgaaattgccactgggatctatttattaaaataaattgaatcgctatttaagcgtaagttaggccattctcaattaattagtgttgcaattaatgattaaattcatgaagaacatatttactggattttaaactgatgccttttcaaaagtatttcatacccacactcaataaaagcttttcacattcatcaatctaattattttgaaaaaatctatgtattgtattgtcaaattcaaatctcaagttttaaatccctacatccaaaagcaagatttgttaactttagaaatgatctaccttcaagatccacatggttgaagctgaagattctcagagggcttgcgcagaattagttaaagcacatcagccaataaagggaaatcattacacttccctccaattactgcacaaccaaagtacaaaagggcattaactctttcctcgccccaagcagtcaagcaaatagcccaattccgcagcataattacacctgttcagcatttgaggattagagggaaggataatatttgttgttacagccagtcttatccaatgtcacaaaataagcacgaccattgtaaaggagagatgaacaacagatcaaactcaaaatggatcactgaatcatgaaagtcagcttaggaacgacaaatataaatgaactgaatctgaagatggaggcctagaaaacggaacacaaaggacatggaaagagattggaaccatttaatttgagaatgcaacatagatatgactcgatagttccaggatgtaagttgttattgcattctatcatggacaaggtaacttacctacactgaggtattggcggtgattttcaaatatcgcagatcataatgtgatatgatgagatagaatgcaataaaatgaaagacatatagaacgggttatcattgtcaaatccctttcattccaacattccaaattaaagagttcggtatgaatccaatctccccaaataggattcgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttagtaattttcatcaatcaaaaagtggagaaaaaaatggtatactgcaagttattctcacatggcatagaaaaatctaagtggtcgagttaagatctacataacattttataatgcaaggcagatggttaaggtaatggatgtttgatgacaagttggtcatagcctcatagaacaatgaaaagaatatgagggaacaccacaaaagctagaaatcgcttgcattatacagaaaacaacagtataacattatgttcactgaatatgtaacaacagacatctttataacatggaaagaattatacgttcttaagatattgtctatgatgaaatgaatgcaagcctagctaggttggccgaaataaatctgacaaagcatgaaacgtttatgagacagtggaggcacggcatacacagatcactctacttagcatgaaaactgcaatttggattttcctattggtaccaatttcatgttccccagagataaagaaatttgaatccatccaccaatgttcccagaaaatcacaactgtgaaagaaaaattcttatccaagccgtatgccggagtggaaatattcacctctccatataggaatgcctttttagtgctataaatatgtattcgcataacacatcagcatagttcagttactcagtggtttatgctctatatgcacctaattaggaatggacttgatttgttcaatacctataacagaccgcaactcacaacctacattgcctcttattaaatctctcttcactaatcaatagcactacagcagttgctcaaattcaccaaaacctgtgactaattagttttggaagcttcttcatctgaccatttgtactgagttgaagcatcaaattgagatctgtgctacaggtaatttacagcagatcatgtcttttcttcaactgatctcgtaattacaaataagcaagttcttagacagagaatagcattaccaatataagctacggtaacaaaatattaattcagttattatgacctcgccaaattcaatttcagttgctgataattattcacattgtttaccagaacccttatcaattattataagatcttaattatatgaaaatctaattaaaagaaaaattcagggagaaagcaatcatgaatcataagaaagtgaatgtgaagctaaagctcagtatcagagcaatgagattaaactttagctaacactctttgcctcgctattaagagatgggacattttgggagaaagctacctttgattaagaggtattctgcaactggagaaatgcactccgggcgccgggacgccattagctgaaaccagcgaggcaactggaaatcttatttgaggcgtcaaacctttcaaatttgattttggccaccgttttattattattatttattatcattatgcattcttcgtcgacatcttgattcgatttgatttgaggtgaagttgaaaatgctacaggaatgaatgttggctgtagcatatgcggcttcatcattgtcatgaattgggacaatctctttttttgcgaaaggacattatttcttttttattagattgtaactgtctctattctctaactatttatttattttgggaggggtctgaaaaatagaaaaagaataaaaattgccaagggggagtgggaagataaggttttaaggacgttctcatctaaaactacaggggtttaagtaattgaaatgacaagccaattacccctcaacaaacttattataaagtccaatctgggatttaattcccaacttttttataataacataaattcatttgctttttaaatgacaaacaaacacttactcttctttttactattcaaatacttatggcatatgtttattgagaccctcttccttatgcaaatcttaattctcaacacatttaattatcaattagttttacctcaaacttaatctctttaacataaatctatacaaacttttactatattattcattatttatatttgtaaatataaatctattttgcgtatcagacatgagtgaattaaacaatagaagattggattgtgacttgaaaagagaaagtgatggaaagatttaattgagtaggagaaagaaggaagaaaaagaggaaagcagcgtgaaagtatcttatccaaaagaacaagttgcaagtattaataagaaaagaggatttttggactcaaattccacaactggataatttcaaacccaaaactataattttgtttttttaataactttccacgtaccattttgattctgcaggcaggcttctgtaacacagactcaaagttatcaaccattcacatatttttctgttaatagatatttgcatgaattattttgttaacaagacaaccacgttttttaagacctaaattgctgataataaccaagacattgtttaatgctatgacatcttagataattctaacgtaaatgatatatggataaatacagatataaaagaaataggagtccatcctaatctagttaggttggtgagttaactaaactccaagaagaacacagagacaatatgataattagtggcaagtgaatgaacaaatttaaatacaaataggccacagttaattcatagccgacatttgggtacgaagacacgcgtagcgcactcactgaaacaagaagctacgctccagaaagaatatcttttcaaaacgtgtttattatggacgctttctccttctttctcagccgaaagttttctcaaagtcctaatccacagctaaacgacaaaccataatcctggtcaaaaccttaatcccatataaatactaccccactttcatacctcaaaccttaaaaccagaaagagatcttactttgtaaattcaatttctttttctttatttcatgtgtttatccaaatgattggggcatctccatcctcttcttggtctcgtctagaagacaagctcttcgagagagcactcgtcgtcttccccgaggaaactcctgacagatgggaaaagattgccagccatgttcctgggaagtcacggtttgatgtcaaggaacattacgaggatttagtttatgatgttaaggagatcgactccggtcgagttgagctgccgagttatggagatcaatttgggttgggttggggggctgctgagtccggcacgagtcaggtttggtttgggtctaaagggaaggaaaaggagacgagtgagagaaggaaaggggttccttggactgaagaagaacacaggtattaaccataagcctctctctctctctctctatatatatatatatatatatatcaagtattgctaatgattgtaattagaatattttttttgatttaattatgcttttaagtataaaataaacttattcgttggtttttgaaggctgtttctaatcggactgcaaagatatggaaagggagattggaggagtatatcaagaaatgcagtagtgtcaagaacaccaacccaagtggcaagccatgctcagaaatattttcttcgtttaaattcagtcaagaaagaaaagaagaggcccagcattcatgacattacgacttccgcgaattcagtgcctcctcaatccaatgatcataactgggctgattatatggatccaaaaccctaccctgatcatggaagcccatcttctgctttccatggttttggattccccgtgtaagttcagctttaaagaaaaaaaagaggtttgtgtttgtaagaagtgaaatttgcatatgaaatagaatgatctcactttctcaaaggatgaagggagaaatttagcagaaatttgaatcatatttttaaggatgaaataggggggaaattatgtgtgttactttcaaaactgtaaatatacaaaattctaagaccatgaggaagtttctacccttttgagttgaatttattcttttttctaagaaatgttcaatctgttggtggagtaactttcaaaggtgttgcactagttaaaaagaaaaccactatatattggaaataaatttttatttaggtattttatgtttatatataccgtaataaataaaaaaattacaaataaatccctaattttttttctaacatagaattgcctctatattaaccagcataagcagataatgaagcaaaaatctgcataaaatcatcaaaatgatttacttctcaaaaaagatttcaacattgaaaaattttaacaactatcggttttatatcgaataatctgacatgatatgtaatattaaaattaaactaaatttatacggtaattttattataaaaaattaatttataatattggataatatttctaaatggctaatagcaggataattgaatattgaaatagtaaaattatggtaagaaaagataataataatgatagtaatattaaaaaaaagaaaaagaaaccatgcaaacgaaaaaaatatttttgaaacgttgcttttaataaataaataaaaataatatatatcaaataattatagcaaagttttaaatttttaaattttatttttgttggaattttcagtttttatttaatttcacaaaatcttataatatttattaaaacttaaatattgaaatgaatatataaattcaataagataaataaaaatcttataaaacataaacagagtttatccaactaaaaataatagaataatatcttaataaagcatccaaatacaaagaaactagtaaacggccgtgcgtggactcgccggtggcatcgcatcgttgtccaagggctccaccgtccttcttaaatttatacaaaactctaattcttcgatgtcgccaccgaaataaccatctttttatacatataaaaacactccaactttatatcgagatggcgatcttgtatgcggtggtggcgcgagggacagtggtgttggcggagttcagcgccgtcacggggaacacaggggcagtagctcggcggatcctcgagaagcttccatccgaggcagattctcggctatgcttctctcaagatcgatacatatttcacatacttagctctgatggcctcacttttctttgcatggctaatgacacctttggcagtgcgttatttctctccttttcaattgctcttaggttattatagacctcaagataaccattctttgcttaattcaaacgctgatgatgatttgattgttgttttaggagccaaattttatacagattcttaaatttggtattgaattgcttacctttgggtttccatttcctcaaattgaatttttatttcttacctcattttttctatacgataacttaggttccaactaaaaaatgttagctgaataacctttttcggtgatatgaagataggtcattaaagccttattggtgatatgaagataggtcattaaagccttattggtgatatgaagataggtcattaaagctttgtccatgtaaagtggttctcttgcagcaggtgtatgaaagtctctaacattttttacttgacctctcaattctatcctcttctttgttctttaatactttagcgaactagttgttgtatattgctaattttgctaaagaattgtcctgcagttttcaccggctgtccaagtaaaattgggtgtcttatgtgtaatgacaattggctactttgtaaatcatgatttgagttatatatgtttgattccatatccaacttgatctgtggtatagccaggttaagaaatcaaggggatcagactagtaatagctggacctaattaaggaggtcaatgctcaaagtgtaccaaatttaaggaggcaattgtcgtttttagatggataaacttaaaagcttacaggactttaatactaaaacttgatagataagtcatgttataagatgtttaaaataacgtcaactttttgtttttttttttttgaacgaggtcaacttttttctttttaactgttacaaatatatctaatttcgatactcagtgttctataaattgtgattttcagcagtctgattggataatatgtttcatatttatctttatgtgacatttatgtgtcaatctgtgcctttatccagggagaattccattttcatacttggaggacatccacatgaggtttatgaaaaactatggtaaagtggcccattatgcccctgcttatgcaatgaatgatgaattttcacggatcttgcatcagcagatggaatttttctccagtaaccctagtgctgatactctcaatcgtgtgaggggtgaagttggtgaggttagtgatttaatggtcttctggaaatttacattctacttatatttcttgttcactatccctttaattttcaccttgtattgtgtatagtagatccctaggtttcagttggaaatttacattctacttatatttcttgtttactagccctttaattttcacattgtattgggtatagtagatccctaggtttcccttttttgttcatggagtattggctcttcaaacatgctaaaaagagtatcagcacaatcatgcaaaaagttatttaaaattctttttctcctttttctttttgggtggggggagtgagatggagttggtggtttatagtttgctgaattctggttttgtcacaagcaattgaataaattatgcagattcgcacaattatggtagaaaacattgagaaaatacttgagaggggcgaccgaattgagctcctggttgacaaaactgctacaatgcaagatagtgcctttcacttcaggaagcagtctaagcgcctccgaagagcgctttggatgaaaaatgccaagctcttgtaagtttctgtgctgctcaattgccattactgctaggattttgtaattttagtatgaatgaatagttacttgacttcttgtccttcctctctttttcctcttttccttctttcctggctctgataggagattttgtaaactatgctgcttgactctagcagagcatcaacgtctaacaaccatatgatagggtaacttaaggcaaagcaacaaatttctcaatatgtaattcaaggagcagtatattgttttaggcggactaaagaggtagaactctagaaaaggaaagaactgcttctggtgaaaatttgattccaaatcttcaatcagacaccaagaacttatttggacatacaaaattgattttttttcctcagtataatggtgtagctagcataactttcttaacaaatgtgtagtccggaaaacttgaataaatggattcttacaagtgccttctgctttcataagtgggcatgaagccacatcgaacttgcctacctgtgaaaaatgcagagttttgaggtgttacttaattaatacagaagacagttgatatcgatgtctgaatgttattagttgctggagcattaaatgtcaaaccttaagatttttcttaatcttttttgaagagaagcaccttcagatttttctgttctccttgattagcttctaaataaatattggaatatgcaaaaaggatggagttttcaatcaaagtttctggcataacaactggggatcctggattccgaaaccaccactctgccatttgattgaaatgaatttggtaacttccatttttaaatttccagatttccaattcgtcatgggaatagttaattttggtggcggcctgcagaactggaagtcttaatgcagcaattataatggcacagtaaaaatggtccaaaatttttgacgttatagcttaatagaaatggcattttaagtaagcacaaaattttttttttacatgacagggccttgttgacatgcgtcattgttctgttgctgtacataataattgccgccgcttgtggagggatcactctaccttcatgcagatcttgattggcttttgtattggtgctgaatttcttctgaggtatgctataatgaattgggtgatccatgtatctgaattatgataaaggagagctgcagtcaattatgatattttgcgagtctcatgtgcaatttgttcctcttcaaggtgctgaaaataatatgatagtcatgctgttgttgcctatggtactagtgatgtatacttttgagaagcctgctgcatatctcccttatatgtcatgggtcgagtgtctattctgtatattactggatgtttaatgctgtggtgtctagagttgttgaacagttagcttttggttccttttatgaccttctacaaacaattatttggtttatggtccagtctgtaaactatgattcatttgtatcccctttacctttatgatgtgattttatattgcacagtgaaggtgcaaggctcataatagctctgtgattttacttctctcactcgctatctgtgataacacacacacagacactcacacacacacagttggaacattaaaggccgtggtgctacatttgctatgagatagtggcgagaacagatatgtaaatggaatggcacatgtggaaattttcaattatggccatctgatgttaatggaagactgatttgcttacttgcatagttagtttgtgaaatttgttttagtttattgtgacggcattcgttgcttaccctggaggtaataggtggtggtaatggtagtgaactgacaggagcgctgggtggtgatgttgccgttgataatggtgtttaaaatataagcgaaaagctattgacaaagcaagcaaatatatttatttttttcctcgttaaagaagggacagttttgtctctctcttgcccttttctccccttaaaatattacctttcatctcctcgtgggttggtgtctgttcagtttgtgaaccagacttgcttttgttttcttactggaatatctgttattgttggaagtgtcaggacttcaacttattaataataacaacaaccgatgcctcaacatcttgcagaggaaaaagatgatttaacaacaacaataactatttcatcacttctttaaaagatggcctcatcctcgagaactcaaaactaagtaaactagttcaatataagcttgaatctcggataataggttggcaaagtggaggcgacgacccttcctaaatttagcaaaatgtgacaggctactgaggaaaatagcttgtgggctggaccctttgtgcctaactcacgacttgaacaagcacaagtttcacgctgcatgaagccacgggcaagtgatgagcactttggttagttgaagatgatggtgggggacagggacaagcatcaagtattttaggcagatggttcagtcggtaatgttgaatttcgccgtcctagcattagtgcgttctctgtataacctgtgcatgacacgtctcacttgtgcttatggcttcttattggagaaagatttattgaacttattttccattttattagtgatgcaaccgggtggtgtgtataatatatatatgcttgtctttttctttttttttttttaaattaataaactgcgccaaaacaggttggaagaaggaatcttttcctttgtgtgacctgggattcctctctgtccatatttcccacccctcgttactttcgttcttttattgtaaattcaaatccaaattcttcacttgtgccaattcccatctttctgtcttactctttaatggccactcttctcaggctattttcaccacctcctgcaaccaaaacttctcagatagcccattcatgcacccctgttttctcttctccaagacccggtttcacatcttcaagaaacccccactgtagaatccgaagcagcaaccttgaaagttttcttgatttgcaacctgagtcaaaatccgagcttttagattttgatctctcacggtttgatccttctagtaaatcccgctttgatgtgatcattattggtactggacctgctggcctgcgcctcgctgagcaagtttcccgctatggaattaaggtatgctgtgttgatccttcacctctttctatgtggcctaataattatggtgtttgggttgatgagtttgaggacttggggtttgtagattgtttgaacaaaacatggcctatgacttgtgtcttcattgatgatcataagaccaagtatttagaccgtccatatggtcgtgtctgtaggaagaagttgaagacaaaattgatggagaattgtgtctctaaaggtgttcaatttcataaagctaaggtttgggaggtgggtcatgaagagtttgagtcttcagtcgtttgtgatgatggaaatgagcttaaagcaagtttaatagttgatgccagtggttttactagtactttcatcgagtatgataaaccaagaaaccatggctatcaaattgctcatggtattttagctgaagtggattgtcacccttttgatttggacaagatggttctaatggattggagagattcccatatgggaaatgagccttatttgcgagctagcaattcaagatttccaacctttttgtatgccatgccattcgattcaaatttgatattcttagaagaaacttcactggtcagtcggcctgtgttaccttatatggaggtcaagagaaggatggtagcaagattgagacatttaggaataagagtgagaagagtaatagaagacgaaaaatgtttgattcctatgggaggacctcttcctaggatccctcaaactgtaatggctattggtggtaattcaggggtagtccacccatcaactgggtacatggtggctcgaacaatggccttagccccaattctggccgatgttatagcagaatgcctcggctcaacaagaatgataagaggaaggccgctttatgatagagtgtggaaggggctgtggccactggacaagaaatgtacaagagaatattactcttttggaatggagacactgttgaaacttgatctgaaagggactaggaatttctttaatgctttctttgatttggatccttactattgggaagggtttctttcctcaagattgtctttagggcaacttgccttgttgagcttatctttgtttggcaatgcctccaattcatccaggtttgatattgttacaaagtgtcccctgcctttagtaaggatgatgaataatttagcacttgaaaccatctaatgatggacgatgatgtacttatttaggttacagtatcagtatcagaataattatgaaattatagtgcatcgatcattccaatttaatgctttcattgtacattaccctctcttgccaagaagctgctatagagttgacttaaaattgccaaccaattgatccctttctaatactccacatacaagtttttccataagtacaaggaaaattaagaaaagtggttaaatgcatgattggttcccaatttttatttttttttgaagatttttgtatgaattttattttgagagatataaataatttttaactattttattaataaaagtttggtgcattttttatactatcattcaaaacacatcgtttttatataaattacatagaaaacgatctaataaagacgaaaattgtatataaactctgcatcttgataataagccattttattagatgtttagttgcattttttagcttgaacttttaataaaattagaaatctgatagtttgttcttaaaattagttttgactttattgactaagcttacgagaatgatgttagtcaaatgtactcattttcatttctatggagtttcaattttctagtactattgcaattcttcctttttctacttggtctttctatgatggatttctttcttctgttattattattaattgactattatattattaatcaaaataaaagattaagagaaaaaaaattatatacggtggattggtgataattatattaattagagttaagttaatgaagtgagaaaagaacatatagtgatttttttaacgtcaatgggaaaggaattatagataataagattgaaaattgagtcctttcataaaaaataaaattcaaagttgggagatttaattgaattaaaataaagattgggggatcaaattgcaagatcccgaaaagttgagggctcatatttgcatttagccaaaaaacaaaagaaaaggtgagtgcacaatattcaacttgtttctgttttagaaaccggaaaaagtaaaactgagcatgttcctcctgatcacagtcacagccatccaatctttctcctcacgacgacacttatatctacatgtactttcaattttagttaattagggttttgaatctgcatatcagaatccatctatgaggccgataagactcccggaaccgccgagcccaaccatgggagtgccggagatcttcgaaactggcgctaacagcgtgataagacgcgccgtcgttattggtaatggttttcccggttcagagaatcaaagtctcggtctagttcgcgctttaggtctctccgataaccatgtcttatatgtgagttttataatttcctaattccttttttaattagtgaagttgaattgtattatgattgtaattttgatttttgtttatgtacatagagagttactagacctagaggaggagtgaacgattggctacactggcttcctgtttctttgcacaagaagttagattatattgtgaggcaattttattattactggacacgcaaaaaattggcgccttcacactcagtaaatggtgctgctgtgggtttatctactgttttagaagctgatttaaagcatattgtcaacatggcccgtgacagttttgaaaagtaattcaacttttctttctctttttaattgtttcctttaataaagatgtatattgcaatttttgaataattatctgagttggaatataaatgtaaaatactattacagaaaatcaagcatgcaattttgagttgtctaattatccagctttagttccccatttgatcaccaagctattaaacttcggagtgctatggattcttttaaccttaactaattattatctttgcctatttcagtacaaaataactttagctgtttctgttaaggaggtgctaatttctcttttgctttctttccatatcatactttttagggatggtcccttattggtggttgcatctggcagagatactatttctattgctagctctataaaacgtttagcgtctgacaatgtttttgttgttcaggtatacttttgaggacttaattttatattgaattctaattgatacaacctgggttagataatatgttgttcatgtgcaatctttttaaatttgtgatctcttgtttaatgtgtgatctctttccatataattcatctatagttgactgttactattttgtttgtttattttctgaaggttttatatgtcaaagttgaatgtctcaattctatctcatatgcaacatgaacacatttgtgttgtcctggttttaatttggctcctgttcggaccaatctagcttacaccatttatcaatgatataaattcttttaagttatacttttgttaggttagcttgacatgttgatattttattgttgcccctttgcttcttgcggccaatttgtagttatagatatggtgaatctttttgctgctgtctctgacattgttcaaggtagcgtttggtccatgttgtcatcactagaacttaacaaactgaagagttaaaaatgcatcttgattacaatttaatgaccttaataataatattacttggtatatatgatcctcctcagaattgatttatacattgtgattgtctcatatgatcttgattttcaaaagaatgctggaaaagttgcatttcagaacttctatgtttaggtcgagacaatggaataggtgcatttgatattattttggaaacaaccaaattataatattttgtgggtactaacttggctccatgctattttagccttatcataaaaggtagcatatgtgttctttagttccttgctgataattagtggatcgaatctgctgccattgaattggattactgctctagcacatatataagacaagctcataaagtataagactggtgactgaacctgtttcatgccattccaagaaagcctgcagtgttccacagtagcactgtaggtgcagcttcctgaggtgtatatgcacgactacttgtcagtatacaccgtttatttcatgctgtattttaatttctgtgctttattgtgattttgttttgcagatacaacatcctaggtcaagtttgaataggtttgacctagtcatcactccacaccatgattattaccctttgactcctcaagcacaggagcaggttcctcggtttcttaggaagtggataactccacgtgaacctcctgatgggcatgttgtatgtagcacaatattatattgcttttatgttttgatttagtgaaactgttaccttcattatgttttatcttctgtcaaaaattaggatttgtaatatactattcttcccaaaattcaggttttgactgtgggagctttacatcaaatcgattttgcagcacttcgtggtgcagctagtgcgtggcatgatgagtttgctcctttgccaaagcccttattagtggttaacattggaggacctacaggtattttttcattacacttttcagttatatttatttttatgtacattgatagtttcactattatcaagatgtaagtgatcagcgttgctttatcccaaaaactagtagtgaacaggtttctttttcttttcatcatttatttgagttcgtcataatattttttaatcatagataattggactggtgttcgctcaatgttctttcttttccggtggactgaaagcataagattgatgcatgataatttctgttaacttttataggttgctgtcggtatggaaccgaccttgcaaagcagttaactgccagtttgcttagtgtgcttgatggttgtgggagtgtcagaatatctttctcaaataggacgccagaaaaggtactacatcatgtctcatggtttctcgcagtttttagacaaacacgtatcaatatggattatgtctctcttgtgattctatttacaggtttccaatgtaataatcaaagaacttggaaataatccaaaaatttacatctgggatggtgaaggtatcatttctcgaatttgaaggcttattttgtttatataaaccaggacttgctataaatcttgaatgccattatctgcagagccaaatccacatatgggacatttagcatgggctgatgcatttgtcattacagcagattcagtcagcatgataagtgagacatgcagcacagggtatgcatgagaaagttgaccggtgttcaatgatttgaagtttttttgttacggtgtttaagtttatatttacttaggaatactgaaatgaagttttccatatcatttgtgcaggaaacctgtgtatgtcatgggatctgagcgttgtaaatggaaattgtccgagttccataaaactttgagggaacggggagtggttcggccatttacaggttctgaggatgtaagtactttttctgctgttgctcttttggaggttaggagaaacatatgagaggaaattttaggagagaaagaaatgagaatctcattaccgtcctaacccgttgtattgtttaaccaacatatttttccatgtagttattgccttcaaatttgctgagcccagttttactgattgcatggacctgtgttattaagtactttagttgcaatgctataccttctgtttttaatgtcactgcccctttggttaattgtgatatgtatgttctaccttggaatgcttgggtggcagtacttgcatctcctatcgggggaacatttctgactttatgcaattaaaagttcatcttctcttcatctttcgactatggattttccttatttactttgatcacttaatgaatagatattatgtttgcttttcagatttcagagagctggagctaccctccccttaatgatactgcagaagcagcccgtcgtgtgcaggaattccttgcagaacgcggattgagactacggccatagaatgtgtttgtaatttgttgttgtaaagatattctctgactttgtattttgtttcaaaagggaatccactgaagttaggtttattcaaaagagctacagcaagctatatagactttaaagttctttcgtcctttatgttttgggctacaaaacatgcaaaataaaggctagctctaaatactttaccatgtatccggaaaaactagaagtgcggcttgtaatgtaggaagaggcagaattttccttcagttctactaaaaggcctttctcattggcagtttggcacaggaattacattttttgaacaaattttgtaagtgggaagctacgcttgatagctttttgtaattaaaactgttatatttgattatgattgaatgattgattcacacacctgggaagcgagagggtttaaatgaaactcgagctctatatctttttctaattttcttttcctatttattatgtcttcgtatctgctttctacttagagtgatattgtaaaataagcagaacgggtggaaggtccgtatcaaatgcctggggaagtgctttgttcttgctatgcatggtctctaagtatcatgttgttattttaaattaaaaacaccaatagaaatccagattgtaaaattggcattgatccaattttccttagtattaagtggagcaagttagctgctggcaaccactcctctctgacgttatacgaacgcctgaactcattcctatagctaaaccactaactagatcccttctcttagtgcctatataactcaaaaactgttcaggggaatttcatatcaagcttttagttttcttcaataaggttaattagtgtcctccccactactaaatcgattaatacctatggattcagagaagaccggtgaagcaaaaattactattcaagagcctaaagctgccgaccctaaaggaaagggtattgctgatgctcctcctccacctgttgtagtgactactgctaaagctatccaaaagctgccaagaggaggatggaaaaagggtgtagccatttttgactttgttgtaaggctgtgtgctattgcaactggtttagctgccactggcattatggggactactgagcagactcttcccttcttcactcagttcttccagttccacgccgaatataatgatcttccaactttcatgtatgcatatttaactcattctacgtaaagcttcagtctcgtcttcaatttgtggaaatgcagcaacctataaattaatgaaaattcctgagattaaaagatataatacttgacactaatttagtcatgcatacttgcaggtttttcgtgtttgcaaatggcatagctagtggatacctaatactttccttgcctttctccatagtctgcattgtccggcctctcgctatagtaccaaggcttcttcttatcatctttgatacagtatgaagaatatgctgaagctatattttaacagaaaaatgatgcagtatgcacattagtaactcactaattaatgtaattgttaaaatgcacaggtggtgatggctctgacaatcgcggccgcttctgctgcagctgccatagtgtacttggctcataatgggaattcaaatgcgaattggaacgcaatttgccagcagttcaatgacttttgtcagcagacgagtactgctgtggtggcttctttcataaccgcagcaatgttgacgttcctgattgtgctgtctgcttttgctctcaaaaggaactgatacaattcttgatcttaaagactcttaacatggtgccgctgttacattacaacgtaaaatgttctgatatagtttgttgggatttgcattagagcaggctgttggttgtcccagtgtggtttgttgttgtgttgtatgaatttggtttggtgttgtacatccatattgtatggtatgatgaatgcatcatcttttagactgtattcatacaccatttttactaataaataaatacacttagaatctcagtaatggtgattagagttatgactttccaaagtgattttcacagtaaataattgtttccatatgaaaaatagaaacctcaagtttgatgagagtataagaaatggggtaaaagtctattgagtagatttatccatacacacgtgctaaagacacacgtgggaaacatagtgaagaagaagccacgtgtaaaaaccgtcgtgtaccggccgtctcctgctactagctaatggtagagtccacctcatctttccccctcttcctttcctacccaccgttaaaaaaaagcagtcttccaatcccttttctctctctaacccaacgaagtcttttattttctctctctgaaatactctccttctctacaaagttatcagctttttcttttttttttcttttattaatttatcgttttaatagaaaaccctagcaacgaccctattctctctctttgattgcctttcaccttttgcagatctcatctactcacagtttctggtttttcaatcttattttttttctctctctctttctggtgagtctttctttcaactcgttctgagtcaactctgcggctttcttttttttcttttttctttttttagttttcattattaatctctgcaatttcatatctattgctctggtttttccttttcttaacctttctgatccatctttttgttataattctggtttctggagtgcggattgatgcttttattttatcttttcttagagtaagaaagtgggagtgaaagaaagttgttaactttgttgttttttgatttcaatgattgagaagattgcttgatttatatcaattacttaaattacgtacatttaagtaagactttcttttttcctttattgttcttttaaacggaagatttaatctttggcttcactaattttattctgtcattctttgaattaagaccagattatatggaggattttctattgtaagagtatgttagtgagattagggcattattaagtgaaagtgaaagttcttaatttttcttctttatgcaatatgaaaaagatagacttgaccaaatttactgaattttcctaccttttccctcataactaaagccttgttttcatttaaaaatgatataagtagtttcacattgtgttgtcaataaatataatgttaattttcgtggaaatgattatgttcattgcagttgagcttgtgaaggcgaattgtgggatttcttttttcgggtaaaattcgactacttagagaaggttattattgtttaaagttggaggtctgggtctcatgagaattgttaggggaatgcagaaattgtttcacggcgaggaggagctgaatctgggctggaagaattccttcagcaaaggaattggcgtcactgtgcccaaggcaagaacacgcgataaacccatgattactatggtctttctctgtctctaaatttgggtcatttgggatcaagaattggtgttcaggtttcagtaattgagagcaataaaattgaaacaatgactcggattttggttcaacgaggcagtggttcttcttcttcaaaccagagccgggcagggtcctcttcagctgctcggtcagagattcaaggtgcagctacccctcaggtcatttcagctctgaaagatgatgaaattgttgatgaggcacagcaacttcatgttgtggatgagctcttggagtattgtgggagtagcgagatcaaggctgcaaaaaatgatgagctaccgatggaaggcttaaatagtgataaaaatgagagttcgagtagcgaagttgttgataacgagaaactggtcaatgctgagggtgtcagatcaggggaattggtaaaaggattggatcggctgagggtaacggagagacctacacctgagagtgatggttcaagcagtggttccccagatgttggcagtggaagcccgcaaccaccaccccctcccgtgccacctccaaaacctttggcaacaaactcaagctcaaggagatctgtatcaggaatttctaatgctgtgcgaactggatcatctagaagagcagttgcttggcctgttgtttccacaagaacttcaccatctggatcacggccttcctcccctaggtctcatggcgacagtgaggggtataatagtgctgatgagcagaacccttgctttggttcctcctatgatgatctggtaagttcttaccactagaactgtactggttgaggcatatctttgttgggttctattctacctttgattgaagtgacagacatgtgacaaatgacagtgttgtgatcttctagaggttatttttgtggtccagatatgacctatctaattacctcattggcattatacgtttttcttttttcttttcttcctatgtggtggaaaatatcttgatatttattgccgtcactggacttcagtgttttggtaaaaattcttgaatgtcttagttgtttatcaagcattctattgattattagcaaatcattctacattctgattgagggttaatgcaatcatgttggattttattgtctaaaggtgggttattgatgtcaggaaagagagcgccaatttgagattgacataaggcggtctaaaggactagaagtcaaaagaatgctagaggatgggaattgtctcttccgtgctgttgctgatcaagtatatggagattctgaagtatatgatctgactagacaaatgtgcatagactatatggtaattaatctgattatttattttaatttccttctgtgttcattgcttaaattctatttcattcctgatgttggtaattagataatggaatggttgatgccatttttaaagcacccaaaagaagcacattagttttcataagcacatggtgaaaaggattatttttttgggagaatattttgagcaaattgaaatggcatattatttttattagcttttaattgattcataatgtttgtatatatttgaatttaaagggccttggtaaatgttatcaatgattgcagtttgataggttagttgactcttacgatcgccattgtttattaggcttcaagttattcctgcttatcttttatgtctagacatttgaatagaataatggtcaatttaacataaaagaaaggaaactgagagtgaagcatggtggcatcagaagatcttctgaataggagcttttatacacctgctatgttattctagggtggaacagttgttattagttgttgtatttgaatttaaagggccttggtaaatgttatcaatgattgcagtttgataggttagttgactcttacgatcgccattgtttattaggcttcaagttattcctgcttatcttttatgtctagacatttgaatagaataatggtcaatttaacataaaagaaaggaaactgagagtgaagcatggtggcatcagaggatcttctgaataggagcttttatacacctgctatgttattctagggtggaacagttgttattagttgttgagtggagataaatgtaaactattacattgagctatgataaggttcgttatttatacttttatttttttatctttttttccagttgtgggaatggggtttggggggttaacactagttatctgttggaggccatttcttgctatctcctgtatacttgtcagttgcctggatagctgtaggagatcaaggattttcttttctaaaatttacattagtctttatgttgccaagtatcccattatgtttgaagtgaagcttaatctttttgtcctattggtttgaattttaaatcttctccatgctaatttattgctttagtggcataaatgataatttttttggacttctgtatttctctgcatgatattgttagtgaggtgtagggctatcctgatctctttttgttcattcaggaacgggagagggatcacttttctcaatttataacagaaggctttacatcttactgtaagagaaagagaagagacaaggtattttcatactctccaggttgacttttcagctttcgcttaattagactgtaaaacttactgaaccttcaatatcatattatcatatattaccttctgaaacgttgtatatatgtttcaagcttctttgaagttatgtttatttgcattaggataaagatgatatacttgcataatttattgcagaataatttgaggtgattagccttgtagagaaaaggaaaattggatagcctattactttccagaatgcatttctctaataggaagttttgaaggcatttgccattctcactgtcagttacatgttatgagtggaatcttttttgacatctttttttcagtgtgaacagaatccctgtctccctcacctgtcagagggacaaaaagggaagagataagagttttttttttttttttttgtttggtatggggtgttatagaaatggcattttatattagagtactactcttttccctgcttcacatctattgtttgcttgaatcctgttatttatgtatttctgatgcaccatcttatcagttgaccagtgcagcatgtttgaggttaattgccttgataatatgggctagaatgaacattgacgttttcttcttaattgtcaggtttatgggaacaatgtggagattcaagctttatcagaaatgtataaccgacctatccatatttactcatataccacaggtagtactttcgtcatttttagtatggatatgattactttaatcattaaatcaagtatgcattgcaacttgcttaatttttcttgctgaccaaaatcattgatgtagagcctatcaacattttccatggaagctacaacactgatacgccacccataaggctaagttaccatcacggaaatcactataattctcttgttgacccacgtcgactgacagttggtgcaggacttggtttcagctgtcttcgaggggtgtgtctctgctccttttgcttaggaattataggttaatatagaaagaaaaggaagggaaaaaaaagaagaagtaattgattttgtagattgaccttctttgttgataggtgactggtgactggtatggtaaaaaaagatcgattgactgacgtaatacaattatatgctatttgcagacaaatgtggacaaggatcaggtgaaagctgcaattaaagctcaacaagaccagcagattgacaatgcaagtttctttttttttttaattacttgtgcagtaaattctatgcagtggtcctgtttttccttactgatactccataatgacaggcacttttagctgaggggcgattttactcagatcttgagcttactgagaaagagattgaaagaatggtgatggaagcttctcgtgcagagtatctggccaatgataagttcaaacagcaactttgtcacaaagaatcttctacatctggtgctgaaccatcttcttctggagcaagtaagtgcacaggtctttatacaggatagaatttgaatcaaatcagtttccaagaaagtggcttgtgaaattgttggcaaacaatttggaatagaactttcctttttgttatgtcttttttttccctcgacttttagtgtgtcttagacatctgacagtagttgaaaacacaggatcatcagacagcgagactaaggtggaaggcacgaggacaaacagtttgcaggatactgtacttagcagtagcatgcagatggttctgtcaatgggattcagctatctgcaagcgattgaggcatacagcatatttggtgacgatgtggattcaatggtctgttacctcttggaaactgccagtagcagcagacgaaaaggcaaagcgactgaatgagccaaaagaaaagagttatgggattacattggctaaaagattacagcttttcaagtaaagaaagaaagaaagaaaaaagaaaagaaaggaaattgaaagaaacagtccaatttaaatgcaagcaaaactgttgttgggacttgataatgtgttattgatgttggaataataaaaatggaaaactagttaattgttagatgagctttggttgcttgaatgttcgtatcatatcttggcatttagttggcagattctttatactatcttaaactaaaatgttgcagtggttactaaatggttgtcaattcatataataaatttcaacttagaaaaactgagatagctagtgaccttttcatttgaaatttgaaattaattattgttcttttttcattggaatttggtccaaaacaattgaaaaagttgaaatttggcctatttaatccctttaccataagttcgaggggcataattaacaacaatacgagcagcgacgacaatctatctgtttagttagtagtagggtcattttagtcaatagtcagcgtttgtacgtacagaccgacgcaccaaactctgcgtgtgcccgccatcatcatcatcgtcatcaaatctaatatatgctgtttattttttcttctagaaccggaagatctgtctagggcttgtatttgtgaattaggggactggaaattggtcaaggaaaatgtcccaaaacggaaagttgatgcccaatatagaccaacagagcacaaagctccttaatttaacagttcttcaaagaatcgacccattcgtagaggaaattctcataactgctgctcatgttaccttctacgaattcaatatcgacctcagtcaatgggtccgcctctctctctctctctctctctctctctctctctatctctctctctccatctttaatatgtcaattattgctttccctctatttctcatttgattcttcatgagcagagtcgcaaggacgttgaaggatctcttttcgtcgtcaagaggtcagtttagtatgatttaattgtgtttattcttttcctgagtggcaattactgattttcttagtttatttcaggaatacacagcctcgttttcagtttattgtgatgaaccggcgtaatacaggtttgtcgaatgcatcttgagttatttttactcttaatgacgtaaatgtatgggctttagagattagttttagctaaatgttattatttggaatgctattgaatgtggtttcaaatccttgtccttttctttactgattgactgttaatctataaatgcaagaccaaagttgctttgctccgtttatttaattcactttattccctttatttataaagtatccttgtcttttgatttctagtaagtcctcatctttatgcattgaagaaaagattagatgcttcagtcctgattcgacgtcttagtacaatatgtaacgttgctcactatttagtagaatcatctgagaaatgctagataatctatctgtaattattgtgtatttttgacaaccaaatatgccttgttgtagttttttagttacctccattctctgagagacatgtacaactagttttctactcctttttacttgtgagtaattgaaatgtcattatcttgaatatgatgaggtaatatcagctagatgatgagatcaaacaaatatcaactcacagaagaatccattatgtttgacaagttaatatgatataagttaaggttctattgaattgattatttggtattatgagtgaactctttgatgtagtttttatatcttaaacatgtaatgtcaatgtttgttactaggctttagttccgttctaaatttttcacaagtgattatgagtttgtttgtatgcataagctctattatgttggtgcaagcagataatttggttgaaaatcttttgggggattttgagtatgaggtccaagttccatatcttttatatcgaaatggtgctcaagaagtcaatgggatttggttctacaatgcacgtgaatgtgaagaggttgcaaatctttttagcaggtaaattgtaatctttggtggaggctatttattgaagcttgtgatgcttttgactggttttgctgaaatattagtttggcatggaactcttgaacctttgctttgtgggtagcatcttgacctcctttggttgatctacatattgaaaaccttccttttgctttcttgtctttgtagcttgactataattttgcaatcttttacaccccaacttcgagatgtttaggatctatataatgcttagtcaagtatttatatcaggaaaaaaggcgctatttctggaaaagttgaaaaatcctctggcagccaaatgcaaacacatgctgcacatcttgagagcggtgtcttcatacaaaatggctaatgttagggctgtgtccaagttatccattctagttcccctttagagcaggatctagggcagtgggcagttgataaatgtgaagaatggtggaatgacttaccaagaaggtgtagtatacatctaattctttctgtttattagaactatgataattgcaaattgtcagattctgagatgatcggacttgtattgtgatatgttcaacagactttcgagaaacaagtctgtaaggagttgaaaatagatgagccttggattgtaggaaatcatggtgccttctgtaatttattgagcactaaattcgacattgctgtgtgttgcaattatcccattccaccaagtaatatatttccatgataagacagaactatagcgtaatatatttttattcttttttggttgcatattgttgtgaatatgactgagttcatctattattttatgctgctagataaagataagtagaccaaccctctgtcatatatcatttttgatatcggtgcatgcaagtcattctagcacctgttctttgcgtgtacaggataattaatgcctactccaaggtgccacaaaagtcaaaggtagcaccaactaaaaggtaacatttgttcctcttaacttaaaaaagatgtttttgggttttaaaattaaataaatcataatattttgctcaattcagttctcactgaaatcaaggattaccttagaatttttccttctaaatagttgtttctcataaatcttgcattttgttgtagtagctaagattttctaacgcacttcaccttttcgaaacaccaatgcttctatgtagcatctgttgtatagaaaacttttcttctggaaactctaataagttggctttggtgtgaaggtcagaatttatctatgtataaaacctgggccatttatcacaaaaagattttgtatttatttattttattttcttgggttgtggaacttaaatatctgatctaaagttaatgaaatgcttaattgcagtgagtttgaggaactggaagctgtaccaactatggcagttatggatggtcctttggagccatcagcatcagctgcctccaatgtcgctgatgcacctgatgatcctgcatttgtgaacttctttagtgtaagtgtcttcttatgtcaagttaattggatccagatttttttttaacatgtttaatattatgttttattgcgaaaaggtaatgcccttgttggagtagcacttgaaacacaaagagttgtcaaacaggatgtctatatgccttgtttctctgtttttctggtcgagcaatagcttgctgtactttaagctatctgcattttattgctttcctctgaatttgcctttgcatttgctggtttaaagttcacctcttatgatctcgtcttacgtggcttaaagtccaggactaaatctttgcttgtatgattgcagacggctataactatcagcaatgcttcaaatgcaacagttgttggacaaccttatcaatcttcaaatccagttcctgtaccttcccatgcaagtagtgttgctattccttctgtgccaacctgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccagctccaaattatggacctgtcttgagcagagacagaattcgtgatgcacttctggttcttgttcaggttagtcacttgatctaaaaccagaattgaaactgaatcatgcttttgttgactaagattcatagagaaaaagaaaaaatacctcttttcttggccatcacaagtggctttacgcttatttgatgtagaatatgtttgctttctggctaataatgatgggctcatggcatgcttactactgcattatgaataaatgtccctggatctgaagcttacatgttgaagttttagtttgcctaaataatcatgcagcaaaaatgggtgtcaaaaaaattgttcatatcaattgtgccaatgggcataagcagatatttcaatttgacattgtactttggtagtttaaacatcagttctctttcttctctctcattgagggcatgtattatagctggaatggacaaaaaaaataaatcaatagtgctgccattgatatgtggttggcttattgtctgtgtaatgcttgttctgattgtttatcttagtatttatgttccgctctgaatttccatacatgctgatgagctttccttgcctatgataggacaatcaatttattgacatgctatatcgagcgctgctgaatgcgcatcagtcttgaccaattggaatggggcagctcccctgagttttttgatcattgtgtagttctttttatccaacaagtgtgaaagaacaaatctgtatagcattttgcctagcttgacaaccatacacttactaaaatatatcattggctttatttgtttataatgctgtttaatgtattccgaaatttgaatatcattctttatcttcatgagaatcaatgtagtcaccaacccttaatatgtaaaccattgattgccttgttgatttgtccattttatagcctgtattttttgtactatgtattgtgcatttccaaccaattataaagacaagataattgaattgtgggaagttaatagtttagtgctatactagctaaaatgtgtcctcttgacagtccactggtcaagaacaaaatcaacatctggatagttgcaatttgatcttgatcttggtcagcttgaatttcacatcttttatgtcgctcctctcacggggcaattccctggaacagttttggcctattccgcaaagagccaaaagatgatctcccgtttccattgaagtcccatctctttccatgagtaggttgctatcaactacttgcactatgttgtcaggaaaagcttcgtgcacccactgcctaagcttctgtttgcagagaacatttcatttgtgggtttcttcctggtgagcacctccagtaacactattccgtaattgtacacatcagtctgttgaaactcttccttcaaagccgtactctgcaaatttggacttatgagtcaagtataacctcacaagtaaatggaaaaagaaagtcaattccttggcatgcactgaaacaatcacacaatattaaagtagtcttaaggtttcaagtaagaaaaaaagaatatagacggaggattacctggtgcaatgtagccaaatgtgcttaaagttctggtttgcatcgtaatattgcgtttctccaaaatcttcgcaatgccaaagtcgcccacatgtgctaccatggcttcatctagaaggacattgtttggttttagatcacagtgtactatgagctctagttggccatggtgaagatattccaatggcagtgcgacatccagcattatgcacactctttgttggagattcaggaaataattatgagaatacaaccacttatcaaggcttccgttcgacatgtactggagaaccaaggctctgaagtcaagattagagcatggacttattactttaatgagattcctaaggcaaatctcccgcagaaccttacattctgcatcaaaacttcgcattgcacgctcttgctgtaagtttagtactttgatagcaacaatagtcccatctgaaatcaatcccttgtatacagaactgatgcttcctacgccaagtagatttgcttcgcagaagttatctgtagcccaaacaagttcatgatatgaccacattcgccactccactgcaggcactaaacctactgaattcgaaacttgaagtttccttgtccggaaagctctcaacaaataaaagaaagaaacaagagctgctaatgatgcaatgcctataagaatatacttgagcaaaatctgcttgctgtgtgaacttgaggctttatttctacagagggactttaagacctagcttcccacagagtcctctatttgctaaaatggattccgctttgaagtttgcaaaaggtcctttacttggaatctctcctgacaggttattgacagacagattcaagtatctgagatacttcaatgcctggagagattttggtatttccccagataggacagatccaagaattccaatgctgctaccaagctgctgatagtttgcggaatgggtccttgaaacaagtttttcgacaagttgagagagctgaggcgtaagatggtcccattagtgcttggaacacttcctgatattttatttgaagataaatccaggttcgcaatgacactcaactttgcactttgtggtatgctggctaaagaattagcagatagattcaagagaatgagactttgtaaggtctatagactcgatggtgccactgagctgaatctgttagaactcaggtctagcttttgcaatctactgaggttccctatgcaagctgggatcccagagagcttattcaccggaaagtatagctcccccaagtttgtcaactgacagatttcgtttggaatcaacccctcaagcaagttgctgtcaagatatagtctctggaagctatctagtcctgcaatctccggtgggatgactccactcaaactgttgtcacccaaaataagataatttatcttcttaaaagacccaatccttttaggaatgggtccttgtaaatggcatcctgctgcagatgtcgtttgtaggggattcgaatgatttccgttgaaacttggcatagagccattcaatggattgtactctatgaccatccaccgcaaggaactacaatttgacaaagcagtgaaaaccctcagttcagaaattccatcctctcccgtaagttgattaaatcctacattgaatcgcttgagcaggtgcaactgaccaagattcagaggaacaggtccatcaaataagttgtcagatagatgcagatctgtaagctttgaagaactggacaaatttgatggaatattttcactaagcttatttgattgcaaaaacagttgtgaagattaggaagccgaagaccggtggttgatggaaggtttccggaaagggcattaaatgttaaagcaattgttatgagagcggagatgttgaaaattgcaggaggtatgaacccagttcagaaattaaactgcaagtctaattctaccaagttgttgagttgtcccaagtgaccaggaatatttccgtgaatggagttattttcaaggcaaagatactgtaaacttgagatattgcctatggaagggggaatagtaccagatagacggttattagcaagatacaggatctgaagcatagataggctacctagagttgatggtatgctgccatgaaatccattaccattaagatgcaagaactcaagcatggataggttgcctaactctggcggtacgtttccatcaaatttatttaaaggcaaagataatcgcgttagttgtttacatctgtatatagttgaagggacatggccactgagctgattgttttgaagaaggatttcttcaagcttatgattattttgacatatatcctttggcagagaaccggagagaaaattgtgtccaacataaatggatacaagagaagtgaggttgaatatattttcaggaatagaacctgtcaatttgttggtccgtagaatcaattccgttagtgttgagatgttgcctagagatgatggaatggagcctataaggttgttttgacctagatacaatttctcgagcttaggtaaggaacccaactctctgggtatgctgccacttaagttgttgaatactagagacatgacttgcagctccttgcactggcctatgcttggtgggatacttccttccaactggttcacttctggaaccagtagtttcaatcggcgtaaacggccaagctcttgcgggatgtagccatggaaactgttgttagcaagcaccagtaattgaaggaatgaaagattaactatatgaggagaaattgtggtccagacccctgaaagggagtctgagggcagtaactctgtcttgtgaagctacaggtgattcctgtccagaaatcagttccaatgctccagttggttgccaagatgctgttaggatcataactaattccagactcgaaggcgagaagtgccgatttatcagtggcattggatgtaactaaggcgaaaccaggcatgcatgagtgcagcaatagcactccaaagagtaacaaaccccgatatcttcccataagtgaattcacgtttgagaaagaaagtggctagatcttgaagtttcttaagcttccaagcaacagacagacagtacatgttgtagttgcaataataaagcacttggtttgactgcagccagaggcagccacctcctgcaactacttcatgctcagcaaacagacaggcagaggctccttctcaccactgatagtgtgatgtttggtcattttcttctccaccttacatatttattctcaaaactaaagaattaataataatattataatataaactatcaaaaaataatataatgatattatatagtgtggtgtcatctcaatcttgcaaataataggaaaatgctaaaaacatacaaatgactaaaatagagaaaagaataatcattttattagtcatgctgtaaaatagacaaactaatttagttataaataatttggttttggattgtacctgtatagttttcaatatttacagaaatactcccccaattttacctgttttctctttccaatttacttcacagattgctgtttctctctctctctctctctctctctctctttctctgcccacaaaaatggttagtctaagggcaactgccaaaggctttctccagataatttcacactcaaaacctaacaccccattgttcttctccacaaatagcgcttccagttccaggctcttcgtcaaaggtgctttctttatctctctcgctctctctctctctctctctctgagcattatgatatgtattaattaactctaacaaagaaaactaataggagatcaatttattagtctgacttgaacctaatttcaggtttacggtagctacttcgagagtgttaatagtagtggaacgagattggtttgcttttatccttttgatcaatgctgccgttttaatcgcactcaaattttggggattatatgaagttaaagtcttaagatttctgcaaaaatgaaagcggaagaataggaaaaagagagactttatttttcttttttagtttagatttttatggataggtgccatatcaatgtctgcggacacacacacacacatatttataagcagtaatgtttggttattaggtttctacactctttgattcaatgccaaggtatactgtgaaaacactagattcagtgatgcatattggatatcatgtttcgtgagtcaagtgtctacattctgtacaagaaatatttttggcttcttcctgtttgagctatcataggaatggcttttatggggttgcgtttacactctccaaccctttctacttcatctctaagtatcttagcaacaacctgttttaagtccttgtcctgtttcagaaagagttcaacttacattttacttttacaactttaatttccatcttctctaaccagtacagtattcgctgtatagttttcttcaccattctactacaaagctgttatcgtctctgcctgaggttgaattacttctctcgaacttcttcctaccatatgaatgagttgacttgtaaagctcatgctccttcagtaagacgtatgtttcactagaatgtccagtgcggtttttcttctgcttctgtctcttgctttctttttggatgatagagctaataggtttaaacatagcaaaatatttcgccacacaggcagcaatttgtcgtaatgttggatttgttagtcactgattgcatgcatgactttgctaagctgctatagcagctataccaagtttttcatcacagattttgtgttctaactaattgatactaaaatctaatatctgtatccattggcatatgcaatttttagtctattgatgttaatcagagtttaatgtgtttgattcaggtatatctttctccagcacaacagagtcattgacagaagcattttcaaaatttggtgaaattgtagaaggtatgaccttatcctatcattttaacctcacaatgaattctttttctcaattattatcttatctgggcaatttacttttcaagttaacataataaaggataaagctatggatagaccaaaaggttatgcttatgtgacctttgctactgagaatgaagccaaaaaggccttgacagagatgaacggaaaggtaactgctttcctttggttccattttttgaatcatggataccaagaataataatggttagttgcaggtgatagatggacgtcctgtttttgtagacaatgtatcgtcaaggagcataggaagactgaggcagccatagttgatattaggttctttgaaacatgaaatgttttctgatgcagagaaagattggtgccatcaattcggtttagaggaatactatcgtatgcacctcttctattctgttgtgaatgtgatgagggacagaccagcgagggcagaccttcttctcacacacaaacaaacaagcaccttttctcctctgtactaatactgcaaaatggttgaataatttgtttttctagccaacataagcatccaacatttcttttatcttttctatttagtttctttattgacttttcacttgatttaatatttactgtgtgatctggtggctttgcatctttccaaagatatagctcaattgtttggagtggaaaaagaaattcataattacatactcaaacttgggtagttcataagataaaagaagagcctaaaaaatggtgggtttcagcttctctagttttctttcaaaactttatttatctcttttcagtacccacactgtgggtttctgttaggagtagtaaatttaccgcaagatgctctctttttttttttttttcttttagcatgtgttatgtataattctgtgggtgtggctttatttagttccttcttttcaacgaattaagggtatatgcctggtatcttggtgcggtcaatctggcattatctggaggctgagctgccattgatcctgtgggatgctgtctcttgacggaaactggtgagaatgatgattatgaccatcagccaatatcaattatctctattctccatctttgatggagttgtatttgttgccaatcctttatctcggaaattacctctatttctgtgttatcgattggctttgtacggaatttgagaggaatggtggctcaatcagtgtaaagatatttcaacaaggcggggcggaggagaatgtggtgccaccgactcgatgagttatctataatttaacagtgtttctgttattatctttcttttgtaggccgatttatggtggctaactcgaatcctaagcttatttgtaaggaagatccttagttatttgccattaaggtgtttgggatcattgagctttacttcataacataatttatgctagatatgtcttgatggttttaatcttaaacttgtgaatgggggctaattgttctgtctataattttaatctagtgaccatttggcaagagagccaatatcaggtgcagctaaaataagactagcaagaagccattgtttcaatttcggccacaagttcttaacattagccagacaagctagactttgttgtcaaaagtatgcaactcaaaacaatgcaaccagtctttggctgtgtccccgtgtctttaactgggcgactctggccaactaaattaccatgcgccaaaaatgtagcattgcattatcattgtcctcaaaattacatcttaatagtatcatttaaaaaatgtatcttatcaaaattttgtcgcacctattttggcacaaaagctattacatatcttcctagggccaaaaatctcaaatgatcccttgtgattctgaactaatcaacaacacaatgcaagttatccccaacaaactcctccgtggcaggcagggaagttctaagctaccgagatagtcttcagtgagagaattctctggaccatatctcttttccagttgtcatgccgttttcatcttacgagagggaggtcgtcggaataagcttataagatcatcaagaccctgttgaacaacacaattggcaattaggacttctaaaattttctccagcttcatgcgacttgtgaagaaaggaagtcatgtcaagtaataatagtaataagattagcattttcaatttgatgttaaaaggataagtgcataccctagttgtgatgacgagaaaactgaaaagcactatcaaatatgatcccagcaccagaagcaacagcaagtcaaatgttacactagcaacctgtcatagcacattttagctgattatcaattaaccaatgggagagatataagaaagaaaaacaatgttttgcataagacaacccactcttgcagtcacatgcattcagcgttaggagtatgccaatgaaacgcatctaaaaacgaatttattttttgccccacttcgccattacaatagtaattctcctaaagtaccaagcaagtataatttgagtagtttgtacatgggttggtcagtactaaatgaatgttgtccaagacaaggttgtgaatcttgcagatttttaactaagagtgaggagaagatcgtatgctatccaagagaaattcttctcccataacattctagtctcaactatagaggttagatgaccataccaaaaagaaaaaaaaaaagtctgcaaatacactctgaatttgtaaccaacagatccaagatacgacaatgaaaggaaagctgtgtccaaaaagagagatgggaatgacaaataagcacacaattgtcatccagagaaatgatagaaaaaacagtagaacctgatatatgttcagcttagctttagtcgagtcgtagaatgtgaacattccatcaagcacttcatgctgtacatttacttcttgaacatgatcttctagttcctgataaagcatcaggaagttgattggtcaaataaaataagaaaatgttaaaccgaggagttagttattatggcatccctaaaaaattcagttttctttctttcttctacttattaaatattcctagcacactacaaactcaaatcccaaacacacaacaacacactgctcattcaatctagcaaaaccaccatatgcaattcaagatgtgataacatcaaaaacaagctgaaaagactccaaactaatatatgccagtacagtcaatgccaccatcacctccttcccccccaaaagaaaatgacaaggtaacaactcagcatgtaaatcaatctgaagaattgaatatgacagtcctatggtatgacattctcaaatttccatgacatgcaaagaaattcacaaaatgtaatttcatatgctgtgcatttgcgagcatagtgatttggagcaaaagttaaattccaatgagagagaaaaacaagttggccgtggccaaaggatgtttgacttagcaaccaataaaatggaaaattttgggaaatttatcataccataatctgcacttaaagtatctttgcacaatcttaaagttagcaccacagaatttaccatcataaagaaaaccaagaaaagtaagaactaaaaatggtcacctttttcaatgccattacaaatgggtcattctttgagagaaatggcgccactcgaggtgtttgtgacaaaagatccaaccatgagcgtatgtaagaaggatttacagccaaactactgttgtctgcaaagatttttatgtttttcccttgatgatcataaatatgcctctgttgataataagaataatacattagggaaaagaactaggattcatttgattttggcattgctcacaagttgccaagaatttaagctggcaacatgtccatatccctatgcatatgctcagacaaagaaataaatacaaaatcgatgcttgcctgggatgaggcactgcctcacaaggctggtgattaaagaaacatgtgcataataaagtagaacatcggaatcataatctatcctaaagtattagccttaagcagaagtacagtaaccttaccgcaatactttcggtgactaacttgatacttctgacaattgcagtttcatttacaaaatatctgtgtagataaccatgatgtcagaaaaatgcgaaaaactaaaacgttaatttttctaacaaagaaagtcaaatgaaatgggacaacctgctatcagacagacctccagtgctttccaacatttcaggtgcaccagagagttcagagagagtggcagcagtgaccctcagccttgaaaactgttcatgctcccaagctacctacagcaggtcaacagctatatcacctggtctaagagatgacagtagatgcacaacatgtctatattaattaaatatattataccagaacacaatcattcgggatattgtgaagtttctgaatctaataagctgaagaaaactcaaaggtgttagttggtggttgttcattccaaaaagacaaaaggatttgaaataattattttgaacataatcagttataagaaaacaaaaatgcatccaccaagtagactgacatcagcgatcattataacaggattaaggcatcttcttcccaaaacaaaacagccaggtactataggatcggagatgcatggttgagacaatgacaaaaggaatatgctatccccttaggcactaaccatgcccttgttataatgccttgtaaaatttcaaacctgcagaaagagataatactcttttcgaaagttcatctcacatggcaagtgggttggtaattattttcaggttagatcaacttactctaggatttgaaatattgattttcttgtgcttcagtccaacttcaaagcccagctcttttgctacactagagaaaccctacacaaaactccaagtcaaaccataaaacatggtaactgaagaacagctctttttggttaaaatgttccaacagcttacttcaaaaatttgtttaatgtaggcattttcaggaggcttagacacatgaagccacaactcattatcccatgagccaatactatttaagcaaatagcataatcaatgctctcacgtaagcgttgatcaaagctacgaagccactgcaaaagtgaaaaccagcataaatgaactgcaatgaaaaaaatggataggtatttaagataataggaaagacaatgaatgcagagatctatagaagatactgaagatataaccaaaaatggatggcaaacaccttctgagttccattgtagttataaggtccgcctgatgttagcccaaaaagtaaattatatcttccccttgtccttggatttgaataaagaagagaaaataacctagctatttcaagaagagccacaatgccacttccattgctatcacttccaactgataatgcctacacgagtaactattttacatcatcatacagcctgcaaaagtagatatagtttaagaagtaaatgaaattacatacaggagcagtcccaaatgtatcatatgatgctatgatagcaatagttggaagttgacttgaatctccatccacttttacaccaggcaaccatccctgtgacaattgaaaaaaaaaaatcattgttcagttcagaaacaaccaccataagcatgaccaataagcttaccagcaagagccgagattagatgcaaaaaggaaaatgaaacagtaactaacagaagtctgcttgcaaacaagcaccattagcatgcttactcttcagttcacatccaaagaaggacctatttgcaaatccattctagccatcaggaattttattttgtaattttataccattgttcagctattttctattttattactcgataaaagggtgtagcatttactggaatatctgggttttttggttgaatttaaagtactttgggagtagaatctacaggtcaacatccataacttaagaatgatgagttattttccatgaaacaaaaaaagtttgattgtgcaggaagcacccattaaagtatatacgtgctattcttttttctctgaaaaaagtatatatgtcttaatatcataatgattatattgaattcaccaatatttccataaggaaaaatgcataatccaatttcttttttccagttttatctaggctcactgtccaactcatggagacatgcacctatagatacattgctgcaaaatgtgaatatttggaaaatatgagagatgcaggggaggtagacccaaaatggtgtgcaatgaagtcgtaagaatagtacagtatcacaatagataataagaagttttaaataagctaaccagagaaatagaatcccagtaactggtggaactataaatcatgcaaaataacatatggaagccataggcaggacaacaagacatctgaagaacaaaaaactggactcaaacgcatcgagtgcataaactccagttcatcacactcgatcattccctatgaaagtgaaagttgagaacctgaatgtttgtgatagtgggggatgcaattctcttaggctctggtgctgcgacgacaagcttgaatctgcaagatttcaagcaaatatggcatcaaaaattttaatagcaataaacaagcaccaaagctttattaatctcaataggacaaagcaacacacatgcatagacagatgtataatatactttgggaaggatcaaccatgagttgaaatccatattacttaatgtttgaattagacacgcaggaacaacaagtgatcagtttctatactaataccaaattttcactaacaagcctgcagagaaaaaaacataagccccagaaaaaaggtaaagcaaaaaaggaaaaagatgtctatcttaattgaagcaaaaagctctgacgagtgatgacctacataaaacttagaaacttcttgtcctatccaaaaaattgaaattaggcaatatacattatacctttgcgagaagtgctagacaaggattactatatggcttgtcaagctatatttacatatattattttaacttatccccattcccccatcccatagaagtatattgtgatgtttatgttgaagaaaacatccaattatgaattatatattatcctgtattgaggatacacagcactacgagaactctcacatcccactaagtgagtaaattattaactaacccgccagtagttgcagtagccggttgaccagtaatatcattcctcttgatatcagtcaatacagcatcaatgtcgtcatcctcaaaagcaaaatacactggatactgcaaccaacgacatggacataattaaatataggaaaaacgtgaaagtagcgagactagtattattgagtagattcactgacaggtacgctggcatgtataagtaagcgttcaagctcagctaatagagtcttgagaagctccagatcgtatgattgatactcaacacctcgtttctgcagattatataatgtttgagggagcaaaaacaacagtcctcctaatggctttctttcagtgatatactctgagtaattccaaaatcgtaattgaaaaagattaaagagatgagaattaaagcaatttaagtaagaaatcaaagagaagagaaagaaaggtacctttaagagaagtgagattgagttcgcgaatagggatgataaggacagtacgggaaagatcagcaccaggagggaaatgcaaggagctggcgtggtggttgagagtggcgagacgagatccaaaggggacgccggagatgtcgtattgaataagacggtagacgtcgacaacggtggcggcgtcgcagagttcaacgcaggcgacgagtatgaagacaagtgcgatgacggattctagcatttctcgctcacgtgctttcttccaagtcattttgttgtggaacggatctcaggatccaatctagggttttcaacaagtgtgcgagtgtgagtgttgggtttgatttgatttgattttattaaaatagcttcttcttttcttttttttctatttttaaatttgggtaatattaaaataatagttgttacttacagtcgcctgtaacagttcatgcgatgaactgaagtgaataaatgaggttttgtttactgtagaaaacaaataattgttcctttatactttgacttcccctcctcctcctcctcctgttgcagcaactgactgccggtttattattacttgcaaataataactgtggttaatcaatctatataactacaaatatgttaggtgtgtgggattacttaaaaccttaaaaataatatttcttttataaaaagaaattaaaccagaccaatacgtatcttcataacaaaagtaaaaagtaaaaaacctctacagtttaatccccatgtcttcatttgaagctgctctaataccaaaatgttttgcaaggtcggtacaatacaaaacagccggcctaacaccatctttgggacatcaaaattaagagttggaaggtatattatgtagtgttttcttttttctttttgcttcacgtttggaaatgtcaaattaaatgttttccaaccttattttccataaaacaaaataagacaacttattaatataacatttttcaccagaaaccaccttgtttcaataggtacaaggagctcaaagacgagcacataacaaatttccaccaagccatactacaagaacccagattgtgtgcagcgttataacctcaaactcacaacttcgctttattacttctctgtaaaccatgtcaggaaaggggtgggtctccgtgctgggatcttctttcgttctacattggaaaactacgactagcatctaattctgctatggaatgactgaaaagagtaaaggcagcgtttgaacacctccgatgagtacataaatgcaaatctcagtcacttgaactttccccgtcttctggaaagagaaactgcaggtcttcattatctctatatacttgaacaagtgctgcagctttgtatacaaacatcccaaacatagccggtacaatctatgaaagaaaaagatgtcgtgtgacttaacagattttacatttcctaagcctactaaaacctatgactaactacttgccattatataatttttcagcattttcacaaaaaaggcaacaggaatgcacaagaaattgtttcaaaaagttacctggaaatcaaaaatatcattggaaaaatagtgatgagacaggacccacaatccgtaaactgcagctggtatcataagcctcggagatgaaagagccataccacttccttttattgatctctctatcgactcactaagatcctcgcttcttatcccaattctgaagtacgagatataccacatcagcttctaaaaataagagtttattattagacttgcaaaataataacaaaaacaaataaaggctggagcttttacagtacttcttcgatttctttttcatgaaaattggaggaatcatttctctggataggttgtctgcatgtttgcacaacagttgaaggtacaagcaactgcactgaaagtgaaattggtcatgatagaagaaattaactacaaaagtcaaaagaataaaggaaaatttccttaatccttttccatagggaaaaaaatgaacaacaagtgctaccattaagttcagcttgatggaatgccagttgatccataaatagcttttaactgagcaaataattgacttatccaagtcaagaaggttatatgctccatttgaatgcgattgccaatgaaactataaaaaatggctctctatctacctctagaaatgaacatccacgttttactttcttcacagaaaaaagtatggatgatcatattttctgttgaggtaaggagaattgaacttgccagctttgcaaagtatagattcacagggaaaagttcaaatttcaaataatggcacctattgataactggcacattaaacttcgctttccttcctaaactaagctctaaatttggagaatcattacaagcatagggggcaaacctagatcaaaaatgttttgcttcagtgaaaacatatcctaaacacaacatattaactagtcttggggtaaatcaactaacctgaaaagtactccaattgcatagctaatagcagcctgcaaaataaataagtaggtcagatttctgtagggaaattacacatgcagttgcttgaatatctatttagcattcaaaagaagatgatgttccaaatttctgagaagtagaagcaaactaccctgttcagatgccctaacctcaaaagtgaaattccaatatctaagtatatatgtaagaactaaagaatctcacaactatatgcagattaatcagctgttgcattattcaagatatttttcactctcaccatcattagcaaatagacagacactaactgattagttttagaagctcacgaccacccttcaaagcatttaatcttttgtaagaataatttatgcaacctacccttcaaaccaagatcatctatctaattagttatgatgctagaggtacctttcccatcaaaaagtttacctggactgataaagcaatcaaacaatagccagtacatgcagttccaataccaactgataaaaatatcagttctcttttgagctgcaagaagaaaaccaaagaatcagcatattctagaacgagaataacacaactacttgtagtctaagtagtgacaaagattgaagttttaactaataaatagcttcaaaaaacaaaagaaaaatgtggttggattgcccattggcagtgaaacataatgacataatttcacattagaggcagcaggtaacaaaagagcatctggtagtccattaagagctatataacataatttccaagaaccagtcactatcaattccatgaatataaatacattacaatcccataaagcaaagacaacatcgatgataaaacacaccaagtccatgaaaaatatcatacagcttcatatttgagaaagttcagtttcttccttctgtcactatcatcttgcatagcctgcattatgatgtatatagttaagtaaagtctaataactgaaatattcatgcagcataatataataatgacataagcatacctttgcaatggctttcttattcattggtgcagagtcagcacctgatatccattcctgtgttctggtcagtttcaaaaaccccccttcatcttgactttccataatctacatatatattaaagccgtaaacacacaaaagaaaaaaaaaaatcaacattgaatcagctttcccacaaaataaaaaataaaaaaaaataaatgaaacaagttttgctatgatgaaacaggactgtccagggtggtggggtatttaaaacaagacacagaatgagaaagaatcatttggcacatccactgcaacgaagaaacttctatggatggtcaataagtttgtcacaggtcacaacattttgaagtatatgattgctctaatccaaatcctaccttgttatcaccaatgataatctgactgcattcttgtcatttcgtttatttatttattatttttgtttggcatatgagaaaggtttcaaggggattggagaatccatgatttgagcatttgagctcctacattgcaaggcaggcattgagctaccagttcaatggtacatcattcttctaataagtagagtttaaatggcataatagcataaagaacatttcttatgtgagatttgaaaaggaaagatacttgaacattagaaaaaaaaaaaagttacttgtttttacttgttctgcattgtttcattatacctgctctgcttcttgagaattgtcagcaagtttagcagcatcaaaatcaactaactccatgacctctctcaaccaaaacatatcggaagctttagaaataaaatctccatttacttctctttccttgaggaacattctcaaaacatcctcttctgcaagttccctcactaaaaaaaaacagaaatcaacatcaaagccatgactacaaacatcaaaatcaacaatatcccataaaacaaaaagtgcaaagtatcctatttgaagcaatagcacacattttccatagctgcaaattgtcccatcccccatgtaacttgcacattctctaatatcccatacgataattagtcattttaggtgaattgcttgtttaaagcaccaaactttttcataaaaaagaaagcgaagattccaaacctggattaggagaagctctaaagaatgagacttttggtgggtttctcctcaaaagtggttttggagatgacttattaaatggagatttgttggaggtggagaagcaagagatactggagagtgtttccattggacaacttaaagcttagtctgcaacttttgtggagctttaggtaggtacttgtgttaagaggactgaagggagaggaaatatctttgctttggagagaggtgtttgagtggacacagacaagagattgatgattgctggctgcttgctctgtttttggttttggtttatcgctttgggcgttttggtccaggctgttaacgaggaggccagaagctccttttaacccttgaactaatattcaaatgtcatattaaacctaaatatttactttttgtcaactcggcccttttctttttcttttttatttaaagaaagggttttaaatggagtcacaaaagcactgcgtgttccctctgcaaccccaacagtcactaaaccctaaacacaagcacctggagtttgctcaaacttaaaccctcaaaggttggtagaaaagagaacgatggagaagatgaagatagaagaggtacaatcaactgccaaaaagcagagagtcgccactcacactcatatcaaaggccttggccttgaggtatccatcttttctttctcttttttattagggtttagggtttagggttctcaacccttttttatttctctccttttacaaattcaataaggcattgtagtgcctttggacaagcataggaaaatcttggcatgatactgaaagtttaaataaaatacttaaaaagtcgttgtttgtactgttgtaaatgtccctctctctcatgttttctaagagaagaagaagaagaaccggcttctaatgagtgaatatcagtagtttcactgtctggtggttaatgtgattctctttgttgagtttggcttctcttttcttgggttgaagattgaaagcctctttctttcattcctcaaaaagagatgaccttagcctctggatttagttgtgttctctccttcagagactcaatgattatctcttgaataaccagaatttagtgcaaacatttaattgaaggaacacttttggtacttcaaacctgtataaaagaaaactggcacgctgtaaatgctagattttatagatttaagcatagatagaatgaatatcggatggtgcttgagtctgctgaaagttggaacccagatgggtaattgatgtgctagatctaagtgtattgagttatggaatttgttgtttcttggattcagttctgtttgatagacaataattctgtgggtcattctgcttttgttcctttccagcccaatggaaaagcaataccgttatctgctggctttgtgggtcagatagaggcaagagaagcagctggtcttgtagttgatatgataaggcaaaagaagatggctggtcgtgctcttttactggccgggcctcctggtactgggaagacagctttggccctcggaatatcccaggaacttggaagcaaggtactactcacattcttgtttctttcactatcttttgagactcttttgtttctgatagtctgctatatgcaattcagatattttcagttcttattttcaatatttggtgatcttccaggtacataatatacttctttttccttgtttatttgcaggttccattctgtccaatggttggttcagaagtatactcatcagaagtgaagaaaactgaagttttaatggaaaactttcgaagggcaattggtcttcgtatcaaggaaaataaagaggtctatgaaggagaggcaagttacattttctatgttcctagccaagagtgatcatcattatttttcatctaacaaacttcttagctggtccaattcatgatgttttgctattgtgtcaggtcactgagctttcaccagaagaaactgaaagtattacaggtggctatggtaaaagcattagtcatgtaattattggactaaaaactgtcaaaggaaccaagcaactaaagttggacccaactatttatgatgccttaatcaaggagaaggtagtgtattttagtgttttgttttggaatgctcaaatcattatgtttcttagattatgtgtacttgaagctattagtgagctttatttttagtcatgaagttgtgcaggtgatcttttgtttaatttactctttcttctcttggactcttcattctacaagtttcattctttttcctaatttaatctcttgaaatacctttatgacacaatttgcaggtagctgttggagatgttatatacatcgaagcgaatagtggagctgtcaaaagggtgggtagaagtgatgcttttgctacagaatttgatcttgaagcagaagaatatgtcccacttcctaagggagaggttcacaaaaagaaagagatagttcaggtacttttatgaactgtggatcctttgtgcctctttaatagcattcattcaggatatggtattactttgacaattgcttctgatgctattttgctctgtgttttgaaaaagtgaatttctttttcccatcatagtcacaatcgtggtagtatttcttcttcaaattgaccactagttggttttgctggcactgagatgctccactatcattttgtaaagcgtgtgacttgataggaagttaagctggcatttgcattttattatttcatgactcatgaaaaattatgttcataaatgattcctgtcaaacatgtccagaactgctttttttattaaagcagtttgagatttacaatccaacaattaaaagcacctgggcacttgatgccgtttaaattggctaaacttgtgtattttataactttttaactttttccggtttgcaagtcattgccccccatttgtgggtttagcctctaacctgaggttttagaggaatcatacaggattgctctgaccttctaatttctgatcatcaggatgtaacactacatgacctagatgctgcaaatgcaagacctcaaggtgggcaagatattttgtcattaatgggtcaaatgatgaagcccagaaaaacagaaattactgacaagctgcgacaggaaattaataaggtgcaactcttttgccactgaattaatcattgaacttaatttatgaatctctatataacttaattggctaaatatttacaagaagtacctgtaaaattttttgattttgaaagcaatttatttttatctcatttttcattttatttgttcagtaattaataagcccattatatttggcttgtcatgatcttattcatttgcatagaggcaagctctactgctttcccaatattttgcttctgaacttttaactataaaaggtgtcactgaaaaagttctcctgatggcaggttgttaatcgatatatagatgaaggcgttgcagaacttgtccctggtgttctattcattgatgaggttcatttttccgctaagccatttccatgtcattttattgccatatttgttttatgatttctaaatcacaatttgcaggtacatatgctggacatggagtgcttttcatatttgaatcgtgctttggagagctcattgtctccaatagtaatatttgctacaaataggggaatatgtaatgtaaggtatgaagaaaggccatgcatgctatgatgatttggttatgcacatgttggaaactctggtggtgagaccaaacttgttcacattgaatcttagtgacccatgaacattcctgatgaataagatccattgaactttttagttgttctaaattcagaaaccagaaagtgactgcacattaaattgtctgagatgcataataggttttatcttgtaatttttatttttaatcactagaatggtcatctgcattttgtttcaccctcttggtagtactttgtctctctatttctcttatgagcattgaatgttatagatactatctggaatttaaggaatcaagatttggaatgatctagttctgttatgttgaatactatcttttggtaacctttgtcacattacatgttgaatggtcaatttattatgcatctctctgctatgtatatgtctttatttgtaacatggatattttgctggatgtagagggacggttatgaacagtcctcatggcattccagttgacttgttggaccggttggtgatcatacgaacacaaatatatggtcctgctgaaatgatacaggttctgtcctacttctaacatgtttgcattgtctactgaacttgttcacaattaattcctgagcaattgattgaacgccaccaaatgatgcgactcttgttgtttgttcagattttagcaattcgtgcacaggtagaggaactgattgtagatgaagaaagtttggcatttcttggagagatgggccaacgctcatccttgaggtttggataaaaaaaattatgttgtgcatacgagttccatttactgtcttaagaatcttcggaatttcattctcccttttctgccgcaggcatgcagttcagctgttatcacctgccagcattgtggcaaaaatgaatggccgagacaacatttgcaaggtaagttttgtgtcaataaaatgagtagctcttttttgtcgagtgattacaccattaaaaagtgcttgttgtcccacttgtataaacattttgtatgttgtgtgtggtgctggggtaatgtgtacaggcggatcttgaggaagtgagtgcattgtatttggatgccaagtcttcagcaaaagttcttcaagaacagcaggaaaagtatatttcatgatagcattatacctgaatgtttgaggagtagcaaatctgtgctttgaccgagatgctttgccgcatagagcatgctgaaattggtagggttttggtgtactaatcgggttgatgaaggcagagatgagttgaactgtaagcagatgcaggaagagatggatgatgggtgaatgataaagaattccatgtgcctttgaatccagcctagtttttaggattagaaagctcgttccagtgaatgtaatggtgtggataaaatgtaagttgaagaaactgaaatagatttgtctaaggaatctctttaattattccaggtcgaagattatatacaatttttgtatttatggatgggcatatggtcccttttagattatgaagtaagcattaattaaagttggagaaacaaaagaagaatataagacagcaatggccatgtgtcagaaagatgttataaaaaggcatttgggcacaatagtaatttttaatttcataattttgttgatactctaatttagcatacaaactattagatttgttcaatctgaagcattgaatgccaatgtttcttgttacaagtatggaatttatacaacaaattaaattaaatttcaataatctttatttttcaaataaatttttgtcaaaatgtaagaataagctcttgaattttcagcctctaaattttaaaatagtttaattacatttttagattttaaaagatataaccattatatttttaaagctaactccgtttatttgaatattttaaattttttaaccgataataatagtatttatttctttattaaagtaaaaaaaaattatcattttaaaattttcactcattaaaagacactactaatactttttatatgtaaaaaattaaattgaaaagaattaaaatgtcaaaattaattaaatttcttattaataaaatagtcagagccaatttaaggatgtaatattttattttctaaaatttaaaaatttaattattattctcgtaattaagaattttacatttatctctttctttttcttgagtattaacaaatccatgaatttttgcaaaaaactctccccttaaatcctccaaacattgccttcgtatagaccggtcctccccaagaagaaaaggaaacaaaaagaacaagattaaggctttaacgaaggtgactcttttaaaacaccaaagctcttcagggaagttgttgctttcggcggaggcataaaacatgggtaagttaagcatggaacagattttgaaggataaacagagcggcgaccctaactccatttcttctttatccctcactcagaaagctctctctgaggtaccacactgttccttctcctttttccttttctttctttgtaaatgcaacactggtactaattcatctaagatgggatgtgatgtaggtatcatgtttgacccaattcaccaacttggagagactggacctcgccttcaacagtctcacttcacttgaggtttgttcaatacttcttctctttttaatatttttatttataccacatctatatttagtattgattgattctatttccaaaacaacaattatcttttctttcttagggattatgttcatgtataaatttgaagtggttatcggttgtccaaaacaaattgctaaacttgaaaggaatcgaagctctctataagcttactgtaagttccactcttatctttttttttttttctttttcttttctgttcatcaaccttccaaaccaaaaacctatgttttctctttgcttgtgaattaggtgttaaatgctggaaaaaataagcttaaatcaatggatgaagttaggtctcttgtcagtttacgtgctttgattttgaatggtgagctttctattgctgtgctacttaatttatccttctctttcaaaggctcatggtattttttatcatgaacttgtataataaattacattttctcttgtacgcagataatgatattgtttccatttgcaagctggatcaactcaaagaattgaacactcttggtattacttggttaacattcttacatacttttcatctattaatctcattttgttaatttcttatgagttcttagtgtatgtttcatgtctatcaaaatctatatcttttagtttatgaactgaggaggagaccatccttctggataggaggaaattctggttgatattccccctgaattaaattttgttcaagtatccactgattttttccttgtaattctcttcttgaaaccacatggcacgtgagcattggagcctctgaattgttattaagcagccccattctacattctcatcgtattttagatgcatggtggtgggatccattgtacagttgctctgatgtcaaataggcagaccccttggaaccctttaaggatgactacttacaactgaatcgtcactttaactctgccaataatgtcctttatgtaaaacatttatctttattctctacagtttactcttcctactgtttttcctacttcaactgtcttgatgattctctaagcaactcttaggcaattacaagttgatgtctttgatctgtccattctctgtaaaggactatgcataacttcacttattgtggctatatattttatttctgcactgatagaaagcaaggatgttttttgtaggatcatccaacctaaattttcagccttttcatatgatgttttaatacataagctgaatagatattttgctgattggagtctggaactggatctattagcattttatctccagaaattaactatgctcttttgttttgcaattctcttgtagtcctttctagaaatccaatccgcgaaattggtgaatcactagtcaaggttaaatctctcacaaaggtaagcagtttgctggataattttgtcttctgctgcaacatgtacttactgccaccaaggcttttataacccatatattgtgcagctttctctctcatattgccaactccagaccattggctcatctcttaagtcctgcatcgagttgaaagagctccgacttgctcataatgatattaaggtaggtgttctactgatcagtgttttcttcattggaattctgttacgtaagactggatgttaggagttatttaatcattttcaccattaattatttcatgtctgttttcttggttccttctttttttcctttctatttttctctcatccaaattttattttgcttgtataattgaattgttctctctctggattgctcagagtctcccagttgagttgtcttataataagaatctccagaacttggacttgggaaataatgtgattacaagatggtcagatgtgaaggtaaggaatttggaaatctttccttttctttactatttttgatctgaaactgcaaatattgaggcataatggaattgcaggtgctgagttccatagttgatctgaaaaatctcaatctacaaggaaaccccatctctgaaatagataaattatccaagaaggcaatgctgctttttcctgtttctttatttttcatttttggtttctgtctagcttttggctgttgagtaattgtttgaaatgttgttcttgcagattctaaaattattgccaaacttgcatatcttcaatgctagaccattagataaaggcaccaagaagggaggcagtggcagaattgatgatttttcacttattcctgttaatgagcttgcagtccctagggaaaagcaaaagaattctttgagaaaaataggtcatgattatgcaactgatgctaaaacagagaaggacctgaagaagaaaaacaaaaaagtggaggacaaactctcagaaaaggaagacgtaccagtctatgaagggggtgaagttatggttgaaaaaaaactaaagaggaaactatcactggagcaagatgatagtaatgatcttggtattgaggatgggaagcagaaaaggaagaaagcaaacgaggaattctcaaagaaagatgttcaagtcgataaagatgattatgatgcagtcaaaaggaaatccaagagtaaaaaatcaaaggaggaacaagatgagcttgatgtaattgatgatggggatacaccatttgctgacctttttgctgttaatactgcggacagcctgaaagttagtggcgaaaagaaaatgctagataaagcgggtaaagacataaatttgatgggcggcgtagtcactgtctcgggaaagaaaaagaaaactaaaaactgtggagcgggttctatagtccagttgcccgctgtgattgaagttggaatgggtggaccatcaacatggggcgatgagtaacgccagccataaggctcctactgcttcacctgttacaatcttatttcaaatgcctcaacagatgcgcacaaaaagtctatcaagatgatctgacgttagaatgttgaaccatctgtggtgtgctttattttcaactcatttttcaaaccattggaatttatttatttattttttgagattgtatgacttgcatccttaaagatttcagatagcttatttatagtaaccatttgatgatggactaaaagttcatttgatattatttgttggatggagtaggtttatgatggctcttcgtctgttgacccttttattattctattgattgttccttccgaaattggctgctgaaattgccaagccaacttgggtaaattccactaagtggaactttcagattctgaagaacctcagttatgaaatgacatctgcatatgattaaatttacctggcatcaatatggttgagtttgtttacatcttggagcacttacgagtaaagttttctcactttggaggcaccagtctttctcgtctcttcttcaatttaaagaattatgtaattggcaatagcacactgctgtagctattttgctggatcattttcttgccaacacataggatcaagcatttatgctgtatgcacaaaagaaagcaaagaatttgccatttaaataaacacaaaagcatataatttctggtaaacttggatgattcgtctcatcttacaatcccatataagcattacagaatgaatgtcataaattattattgcaaggcaatatctgaaatagctgcaaaagtaagaaattgccaacatctggaataaaaacacatacaatcacctcctagcatcattgcttgatgacattctccaagtaccacttgtaagtatcaacaagaccgtccttgagagaaaccttaggactccaacctaaccccaaaagcttggagctatccatgagctttctaggagtaccatcaggcttcgaactatcccaaacaagctgaccttgaaaacccacaacctccctcatttgttcagctaattccttaatcgtgacctcctttccactcccaacattgacgtgctcaatcccactgtacctctccatcaaaaacacaacagcatcagctaaatcatcaacatgtagaaactccctcaacggacttccagttccccagacgacgacctctttggccccattggctttggcttcatgaaacctcctcatcaaagcaggaagaacatgagaattctcaggatggaagttatcatttggaccatataaattggtgggcattccagaaatggcatcccaattgtactgaattctataagcttgacacattttaataccagcaatcttggcaacagcataccattcgttagtgggctctaaaggaccagtgagcaaagcattttcaggaataggttgaggggctagcttagggtagatacaagaagaaccgagaaagagtaattttttaacgccatgccgataagaggagtcgattacattagtttggatctggagattgacggcaatgaaatcagctggataagtgttgttcgcgtgtatacccccaactttggcagctgccaagattacaaatttgggcttttcaacagcaaagaatgagtcgacgtcggattggcgagtgaggtcgagctcggaatgggtgcggagaacaaggttggtgaagccaagagagtggagtttgcggacgatggctgaaccgacaagaccgcggtggcccgctacgaagatcttggaagatttgtccgaaaggaaagacgatgatggatctacatatacagagatcagtaattagaagttacaagcagtgagatgcgaaagcagataggagcggcaataaagaaaatggaagtgaaagatagagagagtaccgtcggccattagaatctccgggttaagcaggcgcacagcacagcagagcaggctctgaaactgaagcagctaacggcagcagttcataaacgttggggaagtggtatacaaatgactgtagaggtacgcaggcttggggtttaaaatgaccgaatgaaatgaacagatggggagcgaggctttgaggtggggaagtgagcccatttttttatttttgggctcatttgattattttgatgaggaaacttcttttatcgacaccgtattattttatacatcttcaaacattaataactattataagttaacaaaagcagtaggaaacttcttctgtcaacttccaccattaatagacttgcaaagaagaaaatcaaaagccatcagtgtcggtaacaaatacagttttccatgacaggataagaaggcacccatatggcgattccccattagtagtgaaatattatagtgcaggaatgcaatgaaaaatctaggcatattaaagttgaatggttggattatgtaaggaacataaattgtctagtttaacattatactggctaaaagaggaagtctttttagtatttgctcacctggaaacgtaaattatgtattggaggatagttgcttatgcacatatcatcaaatatcaactaactaatttccaatcatccttcaatggatacatattttgattagtaaaagagaattatatgcttatgaaatgttgtcatacacttgagacaatggaagcccccacccccgctaatgttgctttacatcacatgcaaccgccacccgttttcctttttataataatagaattggatttggatttggatttgggtaattaacgtaagagtgtttgatggttgtgaatccttaaaaggtaggaaagaaagatgagcactttgccactcaaattaaccaataatttgtccttttgattatgtcatcctcgaacgttcatccaagagtttctttcttaattcttactacttccttataacttgcaagtcttactctctaatactctatattattactaatttattcattattcctccataatcaaccacttatgttaattctatatgttttcttaccacaacggttttcattttgactttgctagacggacaatttgatggtgattttacgctaataagattgcttattatattcgtcttttccatatgatgatttttcttagtgtataaatatttaaattctattttaatgatttttttttttgtatttttgtccactcgagaacggaattttccatgttaacagtagaaaagattagtatattagaagccaaagcaaaaaaggcaccggtgagcggttgcttcataagttagtccatttttctttcaattggttgtttctttctttcttggatatatttatcctccacgtggcaggtagtcaaggtggtggcttacagaagctgccacgttgcccagcagcacgagaaacggaaggaggtagctccggccaccgggattacaggtaactttatagttttaaaaagtaaaagtgtcttacttttcttttcttctgaaaatgtgtataagaaaccggcttttgcatcttcagtttcacgataaacacacacccatttctcctttctttatccctacacaactcccacccatagacacaaatccatttcttcttccattactctcttaaatataactctccagaaaaaaaaaaaaaagaaaaaaccttcaaatataatcatcatcgtcatttaatggctcttgctacacccccatcatccttaactatccatcaacatgaagttggaaccatctccgccgtctatcatgacatctttcggactcacatcctcacccgcctcgacggccctgccttggcttctctctcctgcacttcctccgagttgtacaccctctgcactgaagataaactctggcaaaatatttgcaagtctatttggccatccattaataccccacttatcaggagtgttatttctaccttcccttctggtcaccgctcatttttctctaattcatatcctctgctccatcaccaccgccacagcttcaccaatcttgcgccagcaaccgaggaattgatctcagctgttgatgtttactacaaaagcgttgctgtcttttctgaggttgagaccaccgagactgtgaccgggtgtttctcgtgctctccattcagggtagacatacttcactcagaggaatttatgcctacatgggtacagcatgtgggtgaaaaagactcgtggcttaagcaacttgaagagaatgtaactctaagctggatcttgatcgacccgaaacaaaaaagggccatgaacctgtcgagtaagagggcagtttcagtgcagaggcactggctaacaggggaagtgcttgtcaaatttgctaccatcctggcagggattaaggggtcggagaaggagtacgtggagtgtgagatggtggtgacgtgcggggggaaggaaggagaggaggttcgtgtgagggatgtgagcatgaggatggatgatatggagggaaggtcattgacagggaaagatagtctggttattttgaacggagcaatggaaagaggagagaggaggaaaggggaagatgggaaagagaggtataaggattttttagggaggaaaagagagatgataaagaggaaacagaatcagagaagagggagtgttctggattggatttgcaatgctactggagtaacttattttatggcatagataggaacaaatgtttgatcaatttgtttattcataaattatataaaatactcatatttgcatgtagaaagaatttgtggggctgctggctggtacgatgatgatccgattttcttttattaatttgttataaaaggatttcaataaaacagaaaactcccttatgtacttattgccccaggcaggcaggtatttcaaggatagacactttgatctctagtatttgataatgaaattctgtatttcagtgaatgataactcgacaagcaattctgtactccttctccgaccccttaatccctgccaggatggtagcaaacttgacaagctcttctcctctcacaacttcttgaaagctgggttagaatcagaatctttgctagaaaagtcagccacctcataaaagtgggccttctgtgtttgggctgaaaaagaaaagcagaaatcgaaatgggttattgctttcggagatgaggctttgacaggttagtgttatttcagcaacaaatatttactaaccaaaactcatacatagagaaaggaattccatttgctgtgttgtagtagttttggtttcatgctcatctgttcgtcttcttcttctttcatgtgaccaaagaatttggtttctttgtgcatgtcaatttgctttagtggtattcgttgggttctgccacgttttaagtcccatcaggttagcagcactggccggctaacgtatagctttagtcactgctgccttgttctgatctgtgttgaatccttagaataagagaataacaataataataataatcttaaaaatcctgtctttttcggagcgatcaatattcaagatttttatcagaaagaaacaagaaaactttcttgaattgaacttatcatgttcttggatggttatagaatgagtccctgctcaatggatagtcttaatatgtgcagtaacagtcggtattaatccttccttatgcccaaaagctatgtgaatagatgtgggagcaggcagtcttagttagcagtcgcactacaaccttgacttggcttaaagctacgaacgtgctttcctttattcaaataaaaatgacagtttctgtcctaaaacaaatgttaattttagtcaaagtctgcttttcaaacaatctaatcttatctttcaattttatcatatgatcatgatggcgaagatgaatcttttctcttgcttttccaaagcttggataattaactaaaaataatattttattattcactgagctggcagctgattcattaactaatcacaataagatctattagtacgcaccgtttatgaatgcaactaattgatattttaagttattttgctttttcaagtggagtcgccaacaggcatcatcaatttcagcttgccacagtcaatttatattggcaataaaaaatggaagtcaatctcgatggagtattataattaattatgagatatattgttaattactactttaatatggatgtctaatttgaccaattacatttattgtgatggctaagttaggggaaagagcaccaaactctcgactagttcttcgatttgatgtacaaataaagatatatatattaaatattaaatttaaaaaaaaaaatcttttaaatttagttgaaaattgaagcaacgaacaatatagagttagcggatgacattccgacgcaaaagggatggaagcattggacgcacccttccatttaagatttgaagtttcaattgcgaagaaggaagggagaaacaccaacaccgaacaagctaaactgttattcatcttcattaactaaatccttaacctgatttaattagggttgtggggaaaacaaaattaaaaagcgtaatagtggatgtagaagaagtaataagaaaaaagaatatatttcgttttggtttgaaaagttgataagaagccgctcttgactcttcttctaataacattccatttctttttctttgtttttctatttctctgcctgcctctacacatatatatatatatatatatatatatatatatatatatatatatctctattcaaagcattccccttcttttcattcatcatctcaccagaccctatatatatatatttccaagaatcaaggcagcactcatcatcaatggttccaccatcatcaactcttcatcatcatgaaaatggaaccatctccaccgtccatcacgacatcctccagactcacatcctcacccgtctcgacggtcctaccttggcttctctctcctgcgcttcctctgacttccacaccctctcctcccaagacaagctctggcaaaatatctgctcattcacctggccatccactaacgatcctctcctctccagtgtcatctcttcgtttccatccggacacaggtcgtttttctccgattcttttcctctccttcgtcaccaccgccccacctgccgcactcttccaactccgtttccatcaacgacagaattgatttcagccgtcgatatttactaccgaaacgtacctatcttctctaaggtcgagaagactgaaacggtcagcagatggttcttgtgttctcccttcagaatcgacttactcgaaccaaaagaatttgttcctacgtggatacaaaaggcgggtgaaaaagactcctggcttaaacaactcgaagaggatgtcacattaagctggattctgatcgacccagaacaaaaaagggccgtcaatatatcgagcaaaaggccagtttcagtgcagaggcactggttgacaggggaagtgcaggcgaagtttgctacaatcttcgccggagacagagggaaggggtcggagacagagtatgtggagtgtgaagtggtggtcacgtgcggggggaaagaaggaggggaggttcgcgtgagggacgtgagcatggggatggaagatatggagggaaaggcattaacaggggaagatagtttggttatattgaaggaggcaacggagaggggagagaggaggagaggggaagatgggaaagaaagatataaggaatttttgaagaggaaaagggaatggaaagaaaggaaggaaagaagagaaagtgttctggattgggtttgtattgctactggagttacttcatttttggctttctggtccttcatcctgttcagatgaaaacaaatgatttgggtcctttctgatctgagttgtttaatgtttttaaaagtagaatatcaatatatagcatagaaagagggttggttaattattacattcgtcctttgatacatattcattgggttgaaactttgagagtatatatatatacgatgatgctctgtaagtttgaataaaggcatccagagtttctacaatgttatagaaatgaaaatttattactgaaggtgttcaaattcgctgcaaatatgttggatattaggtggtagagatagaattaagaataaaggaaaggaaagaggatgtttttccttgtttcttttaagaagattaaagaggtatagttgctgaaaacgagttgattaaaacatttaaactgagcaaagcaagttggtacaaattatcaaattttgttcactgctaactcaaattgatagtgatgatgagaatgtcaactcggcatgtgaagcaaaacagaacaaaaacacaaagggtaatatgtttgggttagcaatagcaacgttttcaatttggagatgttcaaataatcaatcacttttttccccattcaatgtgcaaataggagtcggtatataatcttgtggaaaagtcaatggcactggaaatagaataattataaggtcacatatattaatcaacttattagtttccggtgcccacatggcaattaagaatcaatctaacaactatactttaattctgtttccattgtaccactacactaaattaaaatacccaattagcaattatataaatatttaaattcaaaagtctctctctttacgtataaataatgttgtcaatagtgatccactaagaataatacaaatacagacttgaaaggagtaacaaagttggacctaacatccgtccaaaagaaaaaagataataacatggtttaaaaccgacacagctaaacttgatcggcctcttctgtagaaactatctacttcctacagaagacgacatcctataagattaaagcttgggaagggaccggccaccgccgcacaatctcatagccaaagaatctgaattttagctccaagaatcaagaggaaatccttcaactgcccggtttaccaaatgcgaggttgagaaatggatttcatggaaggcccagcattaatttgggcctaacaggaatcaggtccattttcaacagaacacttatctgtggtctgctgaagaagccgaggtagcaaccccactttatccatgcaactccgacgtggcacaaaactattgatcgacagcccatccatgcgatcttcctccgccccaaaaatcttactctcatacgaacaaaaacctaaatcatcagatccaccactgtacatattcttctttctcagatcattccacattttaagtaaaaagaaaacatggcagcaacatttgccacctcatcgactgtcattggcttgtgcagcagctcactatcgtcacccaagaaaatctgccttggctcaggtaagcttgtcaaagttattctcatgaactgaagatatgattttccacatactaactgatttatttatttatttcagggtttgtgaagtcaccagtcccagctagaaatccactgaggcaaacaggtgctaatggaggaaagttcgtgtggtgagtgtttttcaaattaattaatggtgaattgaatattaagattctttgctgtctggatactgtttgctgtgtttctgttttagctttgagagaaattggctgcggaaggacttgaacgtgatagggtttgggttgataggatggctagcaccatcgaccataccagccatcgatgggaagagtttgactggcctcttcttcgagagtattggttcggagcttgctcacttcccatcccctcctgctctcacttctcagttttggtaagtccattttcattacccttcgatgcaaaagtatatatattactgagctgatacagaaatcacaaattaatctttataccaattgtcctcctgtgttttttggattgtttgttaatactagaaagccaagccaacccatcacccaaactgcttagaatgattttttttttttttaaaaaaaaaaaaaggaaagaaaaaggtcccaccgagatttgaactcgggttactggattcagagtccaatgtcctgaccactagaccatgggaccattgcggaaacctggcttatgtttaattatttctgagcaggttatggctgatcacatggcatttgggactattcctatgcctgactttcggacaaattggcttcaagggaaggactgaggattacttttagattgtaatgtaatcacttagtctcctctgtttgtatgatattttaagtatgccttaagtttaactttcatctccttgattcgattccacttgttccacacataacaactctatttcccttccaatgatgtaagatgttccaactctgttatctatttatcttctacatctaggtatacacagaaataggtctatgtttatgaggtataaatgaataatccaccattatttagttaggagggaagatgaagatgaacagctgcaataaattagtttcaggtttgatatatgggtaatcatttgcattattaggattcggattgaaagacaaatttcagcgagataaatatagaatgctttaaactatttgttttgatttggtagagattagattaatatgggacacatatatttttgacaaaaagactcactttcgagtcattccaaggaacatgtgcaatgattcccttgacggcgtactcagattggaattcttagcataactcattcattccaagttgcgctactaagttacttatttaattaagctaatcatcaactaattatactattctaattaacctaacatgtttgaatcattattagtcttaaaatcaagtgccagtctggtgcgcttagtttcacttgccattcacacagtcaaaaaacaacataaatgtagttaaaacattttgattatctcatatatatattttttttaaacgtgttgtgtcaccaatttcttttgttgtgatttaaagaagaaaaagggtatttcttttaaaaagaaaagttatagtaatacttattagttaaatattcaatttcataagaaatttgatagcactgtcaatagccaatacaggaaaaaaaagaaagaaaacattcttccttgttgtttttttgagaaatgaggaataataatattaaacattcttcctgttgacttgcgaaattagtgacaattctgccaacttcaatgtggtgagtgaacatgttaaacgttgcccagtatgcagattataatacggtaatggtaagggttaaaaaggtcctgcacttgtttattataatataccatcaaaaaacaaaagggtccttctaattctccatgcaaattgcagtgcctgattaattgatttcattcaaaagaaagaagaaactaagaagttgctaattatgcttctcatgattaattcctgaaactaaccatttcaggttgcccccccggctgcgtcttcttcttttcttttttaattcaccaataaagcaagtttgtctctctttttgtaagatcagcccatcctattctcagacgcagagatgcgaagaaaaagaatgagctaatattgtcaggaataggaattctgtaacgagtaacaaaagggtgcaattgggaggagcaagaacgcttctcaaatcaataaatattggttaccctatccagtcccacaaaaagacagcagccttggaacctctcaaatccaaaatggccccttcccttcggctcagcacagttacaaaaatcaagaaatccaagatcccgaggcctaaacttactgctagtgtattataggagggagcaaataagagtgtggtccatgatcttgctaaaaagtttaagcagtaattaccctagcaaagagacagcatgggtgtgggggcctcattgcaacaggatccctgtgttttcttgtaagattttctttacccagtttgagagccgttagtgggtctgctctccagtctccagtcttgggtctccacctccaaaaaatttctcctctaataaataatagcacagagtactctgtacttacctgtttgaactttgaagagatactggttggttgtctcttattttcttttttcaaaagaaaatctttttgatcagatggattgatttttgagtgagccgtatgtactggcaaccttaccatatagctattagatgatgacgctcttctcgcaattattcatatctacttttctttcttttctcttgtgtttatgaatcaaattcaatttccgccaaacgtgacatgttaaacccctgttctccaattcaatgacagggtttcatgtcatgccactgtgccttcgcttgcatggtttctttaaaattaaaaatctatttactctcaaactaaaccaaaatcatattaataggtgtacaatcataaatgtatttaaaatgagaagttcgttcttttttttttttttaaatcaaattagagagccacccatagcagcaatttccgttagtcataattatcgaagttaacctctgtctttgtcccagaatgttggataagtgagtgtgaaagtgaaataaaaaccagtatacgttcatttggaataatcttgttgatttcagagactgaagaagagcataaaactgtagaaaaagagaaagaaaactagacctttgcataaatgctaactttccagtgccatgaggctgctgaatctctaataataataataataataattaaaaagaaaaatatagaatgaaacaggtaaggtagaaataataaaaataaaaaagtcagagagtgtaataatatgcaacgatattattttattatttaaaattaataaatatatgttaattatagatcgaaatcaatttaaaatttgaataaatttttttttttagaaaaataaataaaaaactagaaatagaaataaccatagagggcatagtcaagattcagagagtccattaacacatgcacgtctctgattgtatgccttgctctcacgtgtacgccacgtcctctcctcgtctttctgatcgccacagacagccacaagcccacagcttactccaatttctctattattgctgctaataataattataataataatgtgttcttttttctttccctcttcacatctctgaaacaaaagcccacttccaaatcttctgtttctagctgttcaaagaaaagaaaagaaaaacttctgtttcttattgacagttgcccttcactttctttctttctaggttcttgatttcttctttaagactgaatctttgattgccacttcttactttttctttcttttcttctttgaggaattcaaggcaataagtttggacttgccaaaaagagtaaagagataaaatgggtcatcaattatggaccctttgaactttgccacccttcttacccccccaaagtctctcctcctttgaattcttgccattctttgctgtttttgaattacttgcaattcttgaattttgggcctcattttctttccctttatttatttattttttcactccatcaacttacttcatttgtcttctaaaatcttccttcccaatgccaagaaagacgagcaagcacttaatctctcattcaagttccaaaactcttgcaaaatctttcatgttttgagaatcttgttggcgactcctaatttgtaagtttttaggatatcgaaacagggtcattgtctcttctagtaaagagctcaggttttggctaaatagcagggtgcatatatggagtcaaaaagcagagagcattgcaagatcagaaagagagggaattcgtcttcatcttcatcatcaatagtccaaagatacagattcaagagagcaattctggtaggaaagagaggtgggtctactactcctgtcccaacttggaagaccagcacaaaatctccaactttatcaatgccaaatgcagaatccaccaagtgtccaccctcccagagtgggggcaaaactaaagaagcttcggtttctgcaagaaaactggctgccactttatgggaaatcaacaagatcccttcaccaaagaatttagaacttgcgggagatactaaagagcttagaagcggagaaaaagttgcaaggtttccacatttatcagatccatcttatactcctatttcagaggtggatggaccatttgttttatgtttgtattaatattttttcactttttgacttcctacgtgtgtatacttgtttatcttattaaagttgtttttcctgtatgttgtgcagaagatggatagatctagaggaaatggtcacaggagaagagcatcacttgttacaaagaaagttcacctcagtgattatcacttggattctgttgataatgctagtttcatggaggtatgtatatgtgacaactatcgttttctggtcgttttcaagtaatgttatatgtttgaaaattttatagcatgattaggatagcacaggatcatgtcccctggtccatgttttagtggtgttttgaaatgtctctcaaaatggctccacacccaaatgtagctttcagcaccttactatttccattattttttgtaaataaatgcatattcctggatatttcaattaattagctatggttgtcgttagactagaaaaaccttccaagacagtcaatttcaagaactggcccaataatatttcgatagctctccacaatgtccaaatatatggtttttctatgtagtttgtaacgtatgctggtcaaattctttaagtatttgtctgagagtaactcaccaaaatgcagatggaaactcatactaaaggcaagaatcgtagggaatgcaatcttggaatcagaacccgtttgaaggatgttagcaatggtttaacagcatccaaggagcttctgaaagtgctgaatcgtatttggggtcttgatgagcagcattcatcaactatggcccttgtctctgcacttcgtgttgagcttgatcgagccagagtccaggttgatcgggtgatcaaagaccagcagtcaaaccgcaatgagattgagtaccttgtgaaacattttgaagaagaaaaggcagcttggaaaggcaaagagcgggataggattcgcaatgccattgcgtgcgtttcagaagagcttgaagtagaaaagaaactgagaagacagacagagagattgaataagaagcttgggttggaattagctgatacaaaggcatctctatcccaagcattgaaagagcttgagagtgagaagagggcaaaggagatattggagcaagtctgtgatgagttagctagaggtatcggacaagatagagctgaggttgaagaattgaaaagagaatctgcaaaagttaaggaggaggtggaaaaagaaagggaaatgcttcagctagctgatgtcctgcgtgaagagagagttcagatgaagctctctgaggctagatatcatttcgaagaaaaaaatgcagcagttgagaggctgagacatgagcttgaggcctacctacaagaaaaagtagtcagtaaagaaaatggcgatggcaatggctctccaaattatgaaagaatcaaagagcccgaggcttatttgaatagaatacgagatgattcatgtcaaaggattgagagagaagaaaatgaagaggaagtagaaaatggagaagttcatgatggagatgattcagctgatagtgatcttcactccattgaattaaacatggacaataacagcaagagctacaaatggagttatgcttgtgatggcattgctttagataatccgaagcggatgtcagtggatagagattttagggggaggaagtctatctctgagaatattcaatggggaagcatttgtttacagaggagaaactctaacggtattgatggtcctgacagtgctttcatcagtaaaaaacaggagatttcaaatgcttttgatagggaaagattatccgaacttgatttgcattctcaggatgaagatgaaatctcgtgctacagatctgtcaagagccttagagaccatattgtatctggttctagaaggcaaccaatacagaactttgccagtccaacgtgacagtggaagcaaaccctgccatttcaggatacaggcgctacagtttcgaatagttcaccagtactgcgaggtgatagtttaaaagcccagagtgacaggaacaaaaggagaaaagcggactgtgacgagctcatttcatttcctgagaaatgttaaattcctcccagcaggcaattcagttgcatcactcaaatatcagaatgtaaatagaatcatataacacaagctgtatggacattacttgtcaaccagaagtttatctttttttgtggtatatgttcgaattttgttaatgtgtacttgtatttggtttgatttacaaaattgccgtcatgctcacacacacatacacacacaagacaggagaaaaaagaaaagaaaaagcaaatagaatatgtcaaaacaatttcgatcaatgttataacatgagaattggttaagaatgaatacaaactgagatgcagagacgcaagaggatgtcgaagactgtctgccttttgggttcaataatggcattaggataaagggtaagggagagagagaggcagcctaatatttgaggataattattgaagtgcattattatgtaagaaatgatgcttaatgacctcttaaccttcacacgttctttgtgtttttcttgaatatctcaaggatctgcttaaagctggatgttatgagagcagaaggcctacaagaaacatgtttggtgaaaattttgtctgcttgcttacggcactgatctatatcaataatactcgacacttgcaagaaaaggcccaccactacgagcacttggggtggattctttcatgcttcatttcttatttgtcctgttatatatacataatacatgcacatggttggcttgcagtaggttaaaattattctgcattataccctaaattatcgtcaaccgttcatgcacgtttcaaacctatttaccaagctttgatttcggaatataacaatatccttataaatttcacacttgtataggtagtgggtacacagattgtgcaacgtcttaattgctttagctaattagatttaagtgttttcttttacctagttcatttttcaataatttgggtaccagatccctttctaataatgatggagaagctgatatatagaatgctcataaataatacttcattgtatgatgctcactttttctttttaccacaactctgacgttgtaacacgaatatctagtgtttctaaatgagggtaagcaagcaattccggaaggtacatgccatgaaatctaaccatcaagcaaagccttgttacaacttacaatacaagatataggcacttttaaggttacttagcaaatgctcaccataaggtgacgcaacgatgattattacttgtacaattgttcatttattatctctttataaccctcgaacaccaacacggaaacaacagatgtccaaagacgagattctttattcttcacgagtgcaggattgaaaagcaagcaactatttcatttgatacgggaatttccattggataatagccaggcgatcacaaggtacttttcatgcaagaagagatttgccaataaaagaagatacagcagtacccgtatctccgacatcttcgttttctggaaattcgctgagccttaggtttttgtagatgctgatgtgaagctaactgcttttgttggatggtccctcacggtcaagctgagaacttcaggtcttgaatagtgcccgaccacatcaaaatcgaacttcgcctgtgctatttctctgagatctaagcatatgatttcattgcatcaaaatcagagctccactaccgtactactacaactgcaggcatatgatttcttatgcacatatcaaaattaatttacatgggatctacaggcataagaaatttaagtacttgtatctcatgcatgcataataatctgcagatattgagcagaaattttaaatggctgcagataaaagagacatacctaggtctgctgagagcagagcctctccatcatagtttggtcctgctaaaacagttcccaagggtgatataatgacactgcctccgggacagacaacagaatctggagtcaggtcgtcttctgtgccagagaatgtgtactctggaggaggtgggtaatctttcctacggcagaactgattaacagataggacgaaacagccaccttcaagagcaatgtgcttcattgttgcttgccatgtttctggggcatcagcagttggtgcacaatatatttcaacacctagagaaacaaataacaacaggttatatatggaacgctacaaatgataagtctctaaaaggacagcagcttacttgcaactaaacaattatgttatgcatatcataatcatcttccagcaaaactagcatccttactaagattgtcagtgctttatgcacgcacttgaaaattgtagagcagtctgcttgaatttcacatgactagttaaaactaaaagatcaacctagtaacggtcacagttctataacacaaagcataagacagacacataaactaccattccaaagcaccgactattttccacatagagcagactgctcgaatttcttccctacacacattggaaatggaaaagagaagaattcatgtatgtgcaatcaaatcagatgaataaaagacactttaagatatgtcctcgaaggtgatggagagaagcaacatgagaaccggaaaacaagagaaactgatgatatgttgtttctctaatgttactaagcttgttctaattaaaatagctcacctttactataaattgctgttcttagtagtggcattctattttcccagcatatgacagcaccgagttttccaattggagtctcaaaaactggaacagttgatccatccccaaatccccaaactgtacgctcacgtgctgttggcatgatttttctgtgcttccccaggtaatgaccttgagaatcaaaaaacagtacagtacaatagagagtgtacccatctctctctatcacacccattactagatataccttatactttccagccattgctgccaatcgatcaacttcaggtcctgaatgtagtagaaatctttgttatccatttgcagatatccttttaagagatggaaggatatccaagaaatgtcaaaattcaaaacagttggaagagctcttgcggatacctcaggaattaaaatcttcttatcctatgaacagggaatacaaaatttacaatcttaaattccgaaaaattgattggcactaggatccttcatctattaactgcatgctatagtctgtttgaaaagaaatcatcaaaagtactaaatttcaacttgaaaaagacagataacactagtagagtgaatttctggtggtgacaacggtaagactcttgaaacgatatgggcaacgccaatatccacaagaagaagtctaattctactgtgacatcagaaagaaaaagaaactagctatgcaagacactctttgcttattccttgcatcactgtacaaccactaaccatccaagcaacgaaaagagctgtgaaaaaagaaatcttaccaggtacatcaacggctgcagcatgatacttgcggaactcctctctacccttttgtgttctgttcccaatggaagaaccaaaagtcgaaccacgaggataaccaccgatgaatgcttctggaaacacaaccagctgggaaccctctccagttgcttctgccaataacctctcagccttatctgcatgcacatttgggaatcaaaaagttacagcaccaaaattaataataacaaacaagtctttgtgatacataaggaatggttgtgatcatgcctcactgatgctataataaattgatatctccactgtaaataattggaaagacgagaagaaaaagtaagaaaagaccaaaacaataaaacaaaaaattactcaaacaatgcatcatagattgctaaatactatgaccataatcaagtaaggtactttctatttcatctagttgtacttagtcatataaagtgaagtactgtctttttcacatatctttttcttttctgggatctcatctagttgggcgacctttccgtaaatccagtcatatgtcctacaagtttcctaaactaatactggaaaattttagtggtgcgttgattagtttccgaaaagagtaataatcatcaagaaccacagagagcctcaagccagtaattagtgattcttccaagttaattgaactaaaacatcttaaattgaagaaaaggacataccgagagtggcaggagtgtcatagaagacagaggaggcctggacaacagtcgctcggacagttggtgtggaggcgtctgcttccatgttcagctctgatggccgtcagattatcttttgttgggaggggtgatggtacaaatagagcaaggatgaagagaggctacttcctacacccctaaattgtcgttttttaagtacatagctaagatttctttggtccacttgaaagatttgaacttgtctccattcttcactgatttttattttgattggaagagtctgtatttttgcctcaccagtgatcagtgaagtataaaagtcactaaactatccaaatatggactcgagttattcgttttaagactttacctattaaagtgcttttgatttggtttaaaatgcagaccctgatgaaaagtggtttcagattttaaggaaaagattttcaattactataagttggatgtgtgagaagctctggtacttggacaaaatttgaagaaagccagcagctgatgatattaacgaattgtccaggcacacgacactctgccttatggctagtcaggatccatttacaattacaagaactcactgaaaagaatggaccagaccgcgcgttattacatcacatgtactttaagctagtttctcactgtaattacattcagtaggcagaagaaacagaacacaaattttcatgcaagatggagctcgccgataaaagaaagatactacattgtctgatctctgtagccaaggtggtgttggccaaccaattattaatgcagactgttggctggtcaggagtcgactatctgcgagtcttcagttttttcttctgatgtgaaagtaactggttttgtgggacggtccctcacaatcaagctgagaacttcaggccttgaatagtggcccaccacatcgaagtcgaactttgcccttgctatttctctaagatctagcattcattccattaatatcaaaatcagagctcaaatcccatttattaaccctactaatcaagccagcataggaggataagagggaaggacaattttatttgcagccatacatgaaacatagaaacaatttacgaaattagatcaaaattaagaaacagacacatttggaccgaaagcaagatattccttcatataacgaaatgaacaggaataataaatttgacccatcagcattggatcaatcaggaaatttgattcactgcattttgattttatccatataaagcccgcattgtttcgcaaacactaagcaatcgtgtacaacaacatttaacctgcagacaacagaggcatacctaggtctgctgagatcagtgcctccccgtcataattgggtcctgctaaaaccgttcccaagggtgatataatggcactacctccagcacagacaactgaatctggaaaaaggttttcttctgtgccagagaatatgtactctggaggaggtgggtaatctttccgcaggcagaattgattggcggacagcacaaagcatccgccctcaagagcaatgtgctttattgttgcttgccacgtatccctggcatcagcagtaggagcacagtatatttggacacctgcaaagtgaattatgataaagtaaggactgtgatagaaggttacatttataaaagaagaaagcagtctaatgcaatgtcttgcacatggtgatcttctcatcaagcactatagggagttctttcaacaaaagataccctgatgcagaaccagccttcgtcttttaaggcgcaattacgagtagatatcagtaaaagcacaaatctaagaatcatatggatgcaaaaaagtgtacttggttttagtaatagaaactccttatagtgtcattaagcaaaagatagacatacaagtcctttaggaaataactacggactacggttcatagggagcagaaagcctgtcttcctgtctgcacacaaaaggttaaaactggacaagagatgcatacaaataagataaagaagaaaagaaaccataggaatatcttcgaatctgttgagaagaaagaagcaacatgaaaatagatatgttactatgctaacaatgagaaggtaattggattgtttttattgaaatagcttacctttagcatacatagcagttcttagaagtggcattctattctcccaacaaatgacaccacctatttttccaattggagtttcaataactggaagagttgatccatccccaaaaccccaaactacacgctcgactgctgtgggcatgagctttcggtgcttaccaatataatggccttgagaatcgaaaaggagtacagtacagtagagagaatatccatccttctctatcactcctattaccaaatataccttatactttccagccattgctgccaatctatccacttcaggacctgcatttagttgaaaccttagtgacgtttagagaaattatcagttaacagaaacaagagaatcctaacggcgcagaacattttgaaatggtgaaaccaggtgaaaaaagaaatcttaccaggtacattaatggctgcagcaagatacttgcagaaatcctccctgcccttatctgttacactcccaatggttgagccgaaatctgacccacgaggataaccgccgataaatgcttctggaaacacaatcaactgggatccataactagctgcctctgccaataacttctcagccttatctgcatcgatgataggctaccatgaagaatccaagagagtaactcaacctagcaattaatttttagagagagaataaaggaagaaatagtaggagccatggaaacaaggaacctgaatggatcgaacaatccaacaacgagagacgaggaacgagtttagaatcagaaactgaatttttaaaagaaatgaaccagaaagctatgttcttcacatcctaaaaccaaactgaatcagttgtgaaagtaattgaaccaaattaaccaataatttgtcatcctgctaactcctattgctcactctgttgcccaccccaagccattatgcatgcagcatgtttattgcctctttcactacagtaatcatgaagaattcaaagagtgtcctgaggcatcattatatttatggctccaagcaaagtataagctgaaaaaacttaaactgaagttaaagaaagaaaaagaaaagacataccaagagtggcgggagtgtcataaaagacagtagaggcctggacgacggtggctcgaaccttaggtgcaaaggagtctgcttccatgtccaactttggtgttggggccaccgccatgtcctgttagcagtgtagtggttttggctgagagtctgggaatgatgaactggtgtagtgaccacctgatctttttttttctttgtaaaatattatcctgttatgtatttatcaaatttttatgaatttttattgggaggatttgacattcgtggggcagccactctgttaagatttgttttgtccatctaaagatatgagtttgtcgccattctcccaaaacaattatttcatttagacttatttgatctgaatacttgacattgacccatcaagtatacaatctaagccaattattcatttcataaatgatttgtgtcaaaggatgcaaagggatatattgcaacgatgatgatgaaacttgggatctgttggagatagatggttataataagctcaagctgtatagggtttgatacaagtagactcaatatgaactctttttgaaacacttacaatcaattttctttaagaaaaggttgagttaatctttataaactattttcttctcaaaaaaaaaaaaaaaaaaaagaaatttggaataaaaggatgtaattgatataaaatttaattactaaataaatcctctactatgcacttattttaaaatttagctccaaattttcattttcattgatttcaagccttccatgaatttaaaatgaaaaagaaaacggatcgagtgcattattttttaaaactaatatgttattatcgttacattcaatagatagatatgaaaccagtgttttttcatgcacgaaaagaaaatacaacagcacatgcacacttttctgaacgttttgacatgttatttttctccaatttattagtgcagatcgctggctctagtgaagaggcaactatgtctgggagccttcagtttttgcatcggctgatgtgaaggtaactgcttttgcaggatggtcccttacagtcaagctgagaacttcaggccttgaataatgcccgaccacatcaaagctgaactttgcacgtactatttctccaagatctacacatatatgtagcataagaagatgaaagagaatatggggacaccctcaaaggattgtcctctctaatattctttaattgcaatacttttttcatcttaaaacacatttaactgccattatatagttagaagcaacaattaggtattactgaatcctccaggcttgtacttctacgtactgttttagtctatcttctcttcaacctgtagcataattagtaggcatgggatctgataactctctaggtttagcttatttcaatgtatccagtctaactttcttctttggatcaattcagcagacgtgttgaaactgcatttccttatacactagttcagagctaaccttgttttacagaatgtatgaatgatgtactgaaacatatcagctgcagaccagaatggcatacctagatctgctgagattagagcctccccgtcataattaggccctgccaaaacagttccaaagggtgatatgatggcactgcctccagcacagacaacggaatctggtgtgaggtcttcttctgcgccattgaatacgtattctggagggggtggataatatttccttctgcagaattgattggcagatagaacgaaacatccaccctcaagagcaatgtgtcttattgttgattgccatgtttccctggaatcagcagtaggtgcacaataaatctgaacgcctgcgaaaaatggatcataaacgaaacaacataataattggcaaagaagaccaaatgataatatattgttatgtcaatattaatataggtaaattggctactttatattaaagtatcacacctttgccatacattgctgtcctaagaagcggcattctattttcccaacaaatgacagcaccaatttttccaattggagtttcaataactggaagggttgatccatccccgaatccccaaactacacgttcaactcctgtgggcgtgacttttcggtgcttccccaggtaatgaccttgagaattgaaaaacagtacggtacaatacagagtatatccatccttctctatcacacccatcacgaaatataccttgtactttcctgccattgctgccaatctatccacttcaggacctgcaattagatgaatcttcgatatcacaatattgaatttgtatacaagctagaatgacaagagaaatccttagactgagcattaagatttttcaattgttagcattagaaagcataactgttaacatcagaacacaacagtactccttatactgtaagaaaaattagaatgaacttcaaaagagaaccacgtgtcttatcaataattatgactaactattggaaaaaatgatgtctacatatcaccaaagaaagtattctttgaaatagtgcagcagcttgtagacttgcaagtaatcatctttctcaagaagagaattctgtgattttcttgagagatatgttcagcatcattgcaagccactttgaattattctttaaactgtccaattagataagattatgatgaaaatgaaatattaccaggtacattaatggctgctgcatgatacttgcagaactgctctctacccttttccgtggtactcgcaatggctgaatcaaaatttgaaccccgaggataaccgccaataaatgcttctggaaacacaaccaactgggctccattgatagctgcttctgccaataatttctcagccttatctgcacgcacacttaagattcagaattactaccaagcacaataaaataactcctgaaaaaagccttcatattttactgcacagcacaaaccaaaacacacttggaattgcgtataataataagaataccaataactgattgcaaatatttactatatatataaataagacaagcatgtatggcggtatcatgcaaggcggggacgtatcataattccaagcaaaacagaacaaagaggaataaccataagctcaaaagacttgccaagagtagcaggagtgtcatagaagacagaagaggcctgaacaatggtggctcggacagtaggagttgccattttctctctggagaagtggttttagtctctgttttactctatagacccttgtttttcccattagtctatttaagaacatagtattggactacagcctggtggttggtgaggattagttcaatgtaattttatagggaatatgtgtaatcctcctgtggttgactgcttgtgcgccaagccgccaaccattaggagaataccacttatataatcaacaattataaagaaatggtaagagtattactacaacaaaactagtgtgttgcagttaggtgcgcaccttcgaggaacaaagttatgttttctatttcactttttaaacaaatgtatattacataattaatcatatatcatgttgatacaacaacaacaacgaccataaaatcaaagttaatgacgataatttgttcattcagtgttttccgactgaatacttgtctgtcccatgacatcagaaaggcagcctgtgctaatttaatcatttacaataataacaataataagtttttgagccatttgttaattcttagatatttttttactttacgcatgcacagaagaacaaaaaagaaattcccaatcacaaatcaagagcacaagcctctagtacttggtcttggaaaaactcaaattcctcgtaaaaatgaaggatgtaactgatgttataatcatagtccagggcataatactagcctctgctagtgaggattcaagcacaagtaatgtttacagatcaggtgcattcttacatgaattttgatctaagctgttattatgaattacattcagtagccacgagatatttttcatgtaagagaagggtttgccaacagaggaagatacaacaacgcccacatctctgttctctaatgaattcggtgttgctcatccaattaccagagcagatcgttgcctggtcaccacccagctatttgtgagagccttcagtttttgcatctgctgagctgaaggtaactgcttttgttggatggtccctcacagtcaagctgagaacttcagaccttgaataatgcccaaccacatcaaagtcaaactttgcccttgctatttctccaagatctaggcatgatttaatataatcaagattagagctcaagtaccacaattgaaaacaaaactattgtagcctatcaagaaaaggggaagatggacaatcacaaaggataactttcatatgcaagccgtactcattcggtgacagacacaggaaaagttcttgagcctttagatcataattttagcaaacacttaaaaagtttcttctctaactttcaataaaatgataaagaggacaggatacttatggagactagtctatagctaaacagcaattataacctgcgcctgatagtgattgagactctaaaaaccacatgatttttacttcaagacagaatgtggtcttcaatgacagagagatgcctttgagcttcatacgtaaatcctgaagcatgaatgttcatacaaacgccagtgcaaagtgctccagtacccccatccactaacacctacacactatataattccttcatttatgatcttcattcatccttattgtgtttggaaacctcctgcaactgatgttttaaatttcaaaaatttctaatcctattttcttctttgatcggctcggaaacctaattctcagatgtcacaataatatagagccagcattgttttgtaaacattaagaagaacctttaaactcaagaaatataagttgcagttaaacagaagtggcatacctaggtctgctgagatcagtgcctctccatcataattgggtcctgctaaaacatttcccaagggagatataatgacactgcctccagcacagacaacagaatctggcgttagctcttcttctattccagagaacatatattctggaggaggtgggtaatctttcctccggcaaaattggttggctgataacacaaaacatccaccctcaagagcaatgtgttttattgttgcttgccatgtatccctggcatcagcagtaggtgcacaatatatttcaacacctgcaaatgtagaattatggcaattaagatggagaaaatagaggaagagaggtagagagaagagttgcagaaaataaagagagattaaaggatagagagataaagaaatatcaattgtaatgttatccatttcataatgatgtttacaacacatacaggtatttatatgctattagttacaattgcttttcttggatcatgaaaaatttgtgaaagataagatcataaatgggcagagcagtttattccaagtaaaaaataatgatatatcaaaatcatctgcaagcaaaacaaggaatgttttccatcaaaaataccttgagcagccttcatctatcagaagacaaggatttcatttcacttaacagtactaatccagaaatattacagcagattttcatcgttaacgatccaacttcagatcaaccaaatatgcaagaagtatataaacagaaaggaggcatttttctatgcttgacaaaacgcaaaccaaatagcatgggcttgataagctatcactgaaactccaaataggaatgctagacctagctaaatgtgcaagtcagacgcaagcagacagacatctaatgtctagtgaaatataacagctgattacattaagaataagctacaaatatgagcgcctaaagtaccattctaaggagtaaaatgcctgttttacttccctctatacatgcacaaaagaggctcaaactggacaaagaaggcacgtgtatgcactcaaatgagagaaaaaacaataagaaatatttacaaaacctgatcaggagcagcaaaatgaaatccataaacccagtagaagcaggaatactgaattttaattgcttataaatttattattttcaaatatcccacctttagcatacattgctgtccttagaagtggcattctattttcccaacaaactgcaccgccgatttttccaattggggtatcaataactggaattgttgatccatcaccaaatccccaaacaatgcgttccactgcagttggcatgacttttcggtgcttcccgaggtaatgaccttgagaatcaaaaaacaatatagtacaatagagagtatatccttccctctctatcacacccatcactaagtaaaccttatactttccagccattgctgccaattgatcaacttcaggacctgcattcagtagaaacttagttatccatatgaagtatctcacaagcttagagttaaagtgcacaatttaccaaggatggttggataattggttacgttttttacaagatacaattaatacannnnnnnnnnnnnnnnnnnnnnnnnnnnnnnnnnnnnnnnnnnnnnnnnnnnnnnnnnnnnnnnnnnnnnnnnnnnnnnnnnnnnnnnctcacatacagatatggaagaactgtggagagaattaagttggccaataacatgatggtaacttgttctgcctaatcaatgaattgatgtcaactaattatcaccataaagagaaaaagaaaagggagaagattaatatactttatgatgctgactccaaaaggagcagactctgcaacttgataaaaaaactgtgaaatcaatactagcaaagcaaaaaatcctaccttggccctttgcataattgcccaagaaattgtcgatcattccactttgaaccatcaataaaatcatttaagtagaaaaaaaaaagatagtttataagaaatattaccaggaacatcaatggctgcagcatgatacttgcggaattcctctctaccttttgctgttctactcccaatggccgcaccaaaagtggaaccacgaggataaccgccaataaatgcttctgggaacacaaccagctgggatccatatccagctgcttctgccaacaatctctcagccttagctgtatgcattatcaagaatcaaaagcaggtcaaaatctttactttttaactacaaattctttgtctcattgggagtagatataaaagcaaaatcaaaataaaacaaattattgccttgatattatatcacatgaattgcaattgtactttcaagactcaaatatatatatatatgaaaaagcttgactttcttttatggcagtcttctatgtagttcaagttttcaaatgtgtagatagatgaaatcccaaattttctttttttggtgaataagaaatcccaaatttcgagtcttctttctccttccttttccgccgctaatggacaatccataccagttttttctttgaattaaagaatgaaaactgatttcccaaagtacaatcttgattccaagtttaagtaaacgcaagtaagcagaacagcccatgagctgaaaaagctaaaagtgaagaagaccaaccaagagtggcaggagtgtcgtagaagacagtagatgcctggactacggtggctcggacagtaggtgcagatgcgtctgctcccatgtcaacctccgcaaaaagagggccgtcggaagtgagaggtggtggtgtagggacaagcggcatttctattagggagggtggcttcggtgtgttgttattggtaatggttcttcgagaatggtgatttgatgacagagattgttactttagttttagaaaaaaaggacgagagatttctggacttttgacgaggggtcgtgtcttttcttttacctttcttacatataatatatatttatatgtctcgtgactggattttgttctttaatatgatccattaagcatgctgctggcaggtgaaggtgctggaaataaaacatgagtggctactttcaactacaaacaaaagtagccatttggattcaatccaaaattactgagctgaaaagatcttctttctctttcggtgggaagtgaattcaaattatagatatcagtaaaaatcataaaactgtaatcaaagaaaggagacaagacaaccctctaaaaagatgacaaatctacaaaatttggatgagctcttgcagatacggcatgtgattttaacaaccaaatgcacaatctaactgtattgttatcttatgtcctgaactccggtcaaaggacacatctttacaaacacaattcctacctgttatctttaaaagcaatcatcaaagcttaaagaatgttaccagcagctggatcaaggctttggcagaaaggtgatcctcgacctacattctctgatttttatttttataattctaccaacagggtaaaagggaacgtgtcgctgccacggccatgcggcgacgacaccagcaaatgaaaaaagaccaggtaacatactacagacgcagacacgtaaagccaaacccacgtgacctattttcttcgtgacggtccgtacttaagctgtagacgtgcccttcacttcactccgttcttttctctccaaaaccatttataccaaagctctctcaaaagtcaatcaaatccctttcactaccaaaggaaagaatttttgatttctaatttacttttaattgctttcttttctagtcttcttctttctcaaatcagaaaaaaaaaaaaaaacaatggcgggagtgtcgagagagacgcagatgtcgatagaagcatcgtctatgtttcctgggttccgtttttccccgacggacgttgaattaatatcttattacctcaagaagaagatggagggcgctgagaagtgtgtcgaggttatttctgaggttgagatttgcagtcacgaaccctgggatttacctggtaattaaaccaatttaatttgcgttgtttgcataattcagctgctccacgcgtcaagttggtgttgcagcctgaccgcgtcattagtataaataatagcagaattccagcaagcgcacgggtttacacctttgtctactatgtttctttttcttcttatttcagattttaacttatttatttatttatttggccagttcagtttttaatacttcgttgtgagtccgccttataatccttagagactgcttaaagaagaaagaaagaaaatgatacattttggctgtggtttaatttggaatgatgccgcagagtgcaattttctctccataaactaactcaagtgtttccccttttctatttggtcactgattttagtatttatgagcagccaaagctgtaatccagtccgagaacgaatggttcttcttttctgctcgtggaagaaaatacccaaatggcacccaaagtaggagggcaacagaactcggttactggaaggcaactgggaaagaaagaaatgtcaagtctggctctgatgtcattggtactaagagaactcttgtcttccacattggtcgtgcacctaaaggggagagaactgaatggattatgcatgaatattgcatgcatggcaaaccccaggtcattctcctgtcctacttatatatcccttcttttcttgttttttttattcaaccactcctgtattcccttagagagcagcaggcatctggattcttgataccctcactctgcattccaaagcaaaactgttttcttttttgttttgtttctttcaattagaactcggactatcctcttctttcctcccctgtgtcttccctttgcagctgcagctttggaagtctgtcaatctttatttgagctttatatatgtattatcatttcatttctgacaaaaataaaatcaactctagatgatgacgcatatgttttaatttggtcccatgatctgcaggattctcttgttgtttgccgccttcgaagaaatgttgagtttcgtccgaatgataattccaaccgaaattctctaaataggagacagttatcagcttctgatggtggaattgagcggacgggcatgtctgaaggggacaagagagcagaatgctcaagaaagtgtagtagcagttatgattctcattctattgagcaaattgattcggcatctgaatctgatcagaaactatcaaacgaggctcctctggcagagtcatcttgccaacagcaggtcgtcttctttttggcttatgttttaatttttctttcttttaaccttttggaaaagcaaatcttctctcttcttttgcttatttctctaattcttttcttctaatgttttcaagtcgatattctactctagagttaaaattctcagtcctggcaaaacagaaagcaattcgtaatgtcagttttgatgtgaagtaacagatataacattggtcaaattaatactctccgagtttcaagctatgattctgattcatgttgctgttaaaatgcaggattctgataaagaagaagatttttatgctgatatactgaaagatgatatagttaaattggatgagactccattttctgaagcgcaagagctccttccgttcattgccggtaaggctgagacgcaggcacaagctcaaatgcaacagcctatgggaataattgtgtcgcaagcaattccaccaaattcaattgcttcccaaggaatagcaaacagaagaatcaaattaaagaggcaagcaccccctgcggctgatgcagagccatctggaagcggcaaggaggaggagtcgccaaaatgtgtggttagcatggcaaaacacagacccatatttatagtttttattatcctgacattgctggctttgttagcgtcttggttatggggttccttgcatacgaagagaatgacatacggaatcctgtacaaagccttctgggactgattcccggcaagcctctgtgtaaaaaagtcaaatcagggaacctttttttctcataattcgcctttgaatattagaacataagcttaagcattaattaatagaatgattagttgtgggagttatgggatgtagtggcaacttgtattgctgtgcttttcatattcattcttggaatactgtactcctgagggaagtgattgatgggtagactgcctgggaacgtgttttggtccttgaaagagtgtgcacaggccacctatttgtttgtttaccaagcatttgtaccgggtttccttcaccctttttagaggtaacaaaatgaaccagaagtaggaccaaactgagagtttggcagcataaactaagatggactcgtgaatgagagagattcaagtctcctctattcattggaatcggtgggagaattaacaagtggtccactttccatttcatccctgtagttctgaattcttaaattgaaattcaccgattggattggtccaaccaggaaatgaaatgcagctttgctttcataacagtgacgcgtgcgaggcaacctgcctacttttctcctttataaagcgtgatccacgcactcatatcaatcattcaatcctttcaccagagactttatcttgatatacccttgtgttcatctctcccacccaaccatatgccgccgtttgacgttaaacttaaaaagagttctcacttccatctctggcagagcactcgagagtttgcggtccatggacgtcgatggtcatctccttctcgttgagattgaaccaataacagcaaacgatcatctgagagtacctctcatactaactcaaaatatgaaatacatttttatgtacaagaaaatttcacacttgtaattaataatatgtttctcttttcagttttgcattaaaaaccctattctgccaccaaaaatatataatgggaataccattctcaattgtcaattctactttacgttctttttatcaaattttttaatttgttatacacaaatatttaataaaacttatatctgataaccaatattaattattaagattctaatagagttttagtgaatttttagtattatttatttataaatatattttttttatagattttctattcttcttttgtataatatttggttgaaatctataaaatttataaaatttaatattctacataattaaatttatatagtatttgttataattaaattaaattttaaaaaaataaataaaatttctacatattaataaatcaatactaatatatcttttttaatcttatcattttcattttattttctatttcatatatttttcttaaatgaaatgagtttttttatggatttcaatcaataataacgataatctaccagaaaaagccaatagaaatgtcatctttcgttgttattatacttcacatatttttcttattaactttaatagtttattatgtatgaagtcagtcatatagttaaacgaattattaatatcatttactaataatttttgtaggaaattctttattagggatcctgttcttgtgaagaaaactacacgttctttataatttattatgcgtggaacaattcagttaatatataagttgtcgtttagtatattatggccctgttgcttgcacttgaatatgaatggaatagcacgtaagtattaatcaatgatggacatttcaacgctaactgctcccatttagacatgccatgtgactctgagtgcactagtttctgcccgccggaatcatatgcggacaagtcggtagttttcaggagtgctaaaccccttttccatgaagaaaatgcgttaaaataccacatgagctgccctttttttgggacagttgttgtcttggagacgccgcgagatctctctgcctctttgatcttccttcggcactctgcttctagttctaattatcacaacaccctttctttgctttatcatgtcaaccctctcactattgtcaggagctctaagaaggtacatattagcatgcaatttcttacctatttttcaggaaatcaatcagtttgtaatatatatacatgatatgctttctgcaggctggaaggcaaggtggctctgatcacaggagctgctagcggcatcggcgagtgtgctgccagacttttctccaaacacggagctaatctggtgattgcagatgtccaggacgaattaggccactcagtctgcagagaactggattctccatcgtctgtctcatacattcactgcaatgttaccagagaagaagatgtagaaaatgctgtgaatacagcagtttccaagtatgggaaattagacatcatgttcaataatgctggtgtcgttgggatagcaaaaccaaacatacttgacaatgacaaggccgaatttgagaagattattagtgtcaatttagtaggtgctttcctgggtactaagcatgcagctcgtgtaatgatccccaatcgcaaaggcagcataataaatacagctagtgtatgttcaataattggaggggtagcatcacatgcttacacaagttccaagcatggagttgtaggactgacgagaaatacagcagtggagttagggcgacatggaattagagtaaactgcgtgtcgccatacctggttgcaaccccacttgcaaaagatttctttaagctggatgatgatggagtctatcgtgtttattcagtccttaaggaagcagtgctcggtccagaagatgtagctgaggcagctctttacttaggaagtgatgagtctaaatatgttagtggacataatctggtggtagatggagggttcacaaaagtgaacccaggtttctgtatgttcccacaatctatttgatcttcttccatctttttctcacaaaagaaaataaaatttctagtactcatatccataacattttctatttttgagtttcataaaactattttcttaccatctttcatagaaagaagacaaatatgatgcaatagaaaaaaaggttcatgcatacatatgggtttcaatatatttaaaaaaatcacagtgccaagcaagtctgtccttcgtctcccaccgaaatttccaaaatagctttcgcatgggcagcaaataaaattgttgctacagtggtctgtttcagtttcaatttgcatttagaagatctgatacctgacaagagctaaatgaaagctcctagagtttgaattctgtaaccaatggatcatcccatttgaaagcattgtagctgtcgaaaaattgcaggaacataaaagagtactctccaacatagaaagccagatcccttttaaacttgggatcttgcaagaatatcttccatggagccataactaggtttttgcccccagcaaaaggataaaagcaagccaaaccccataaaatatggttgacctggtgttgaaataaacactagctagatttctcatagttgatgctttagccatataactgaaaagtagatagaagttcatcatcttccttagaatttgctgtagaaaaatggaacctcttgtccgaggcctcgagtaggcttcaaaaaaggaaaagataaataattgaggatgatgatggctatactatagccacacgctgcataatcagaaaaccccatttgaatcaagattctctcaagaaaggcccgataataatcatatccaaatcaatggcactggatctgtatatttgaacatgacttttcttttctatttccacggctttttctgtattttctgaaatatattttttaatttatataaattattcttatagattattttttttttcttttaaattctctctctcttctcttaatataaggtatttaagatattttatttcacctaaattttttaatttttttcattgatgttgcatttaaatctttttttttctattattattttttatatataattactagcattttgcttatatcagtgcaagattgttttatttattttatatattatataatttaatttataattatattaatagaaaaaatttactttattttataatacttttatttatgtacatattagtatttcataaaaaccataatacattcttatgaatttttttttatttttatatgctaaggtaaataaatatgagaaatatatatatttatcaattttaagtctttatctattttactacactaaaaaattctcatatatttatatatacttatttttaataaataaaattgttagaacttttgctatttatctttttttattattattttaatatcacatatacataagttaaatatttattatttattatattggactaataaatttcataatattcttcaatttaatttcttcattattctttatttgtcatggatttttttctataaacagataaatttatcgttattttttttttactttttctatgctatggtagttaaattcaaattaatagtctctctatataaaagaagtattttaaaagtcgttaggtaactaaattcaaatcaatagtctctctatataaaaagagtattttaagaaatatatattttttaaaatatatttttatttttaaaaattatttttatgcattttgatatattatttttttaattttatatcacatattttaatataattttttttaacagtagcacttttttattctttgagaatatttatatattttttctttaattatttaattaaaatttttatcagtttatccatattattatttctttcatttttaacaatacaaatttaaatttttaatttttttctaattttttcagatattttatttaaaaagataatactaaagcagacattattaaatactgaaatttagtaactaataatttataatatataattatctaatatttatataaataaattatttaataatattttaatccaacaaaaacgggggtactggtctagtttatttatgataagagttaggcagggagcgcatggaaaagtttctatgtccaccgtgtgctcttcttcaacctaaaatattaaacctaatatcttaccacccaacaataattacaatatagttgcttactttttactaatattaaaaataaaattttacatttcaaataataaattttttaaaactttatagtgttttaattttctatttattaaaatatgaaatggggactaagatttggcttagatattttaaatataattttataagatgactggttaatataaagaattatatatataaaaagtgaatagaaatgatctgtgcaaatgattgggttgtatgcttaaagagttgacataaatatgaatttggtcagcaaggtaatgcgtgggcgatcatttcagtgttgaatcctttttcttttgttcctttccgccattagcatttgcttatactctctattacaagtagaacccccaatttcacagaatccattttaaaagcaaaagctcctatctttttattagctgacactcctcgtctctgctcctctccactcttcttttgggccaacttttaagtcatgactctggggtttgctcttccaattccatctgtaagctttcatttttcttttgattccgattccacttcattttttttaacactggaattcccttactctttgctttctctgaaattgttagtagggaaatcgaaatcctcaagttcccaatttaattacccaatagccaaaattgaaggatgaaattagggttcttttatccgacctctttattagctgctttgctttcggcaaattctaagctttgctctgtttaggagatgcttaaaaactattatgaccatattaagctcgattctctctagcttttccacttatattcattttagaaaagcagtgtactttctttggaaaatgaattccgttttgttataataacaaggttatatttcaggaatgggtattgtatttctcttacttactaactaatgtatatttggtctgctttttctttacttgttgaccagatattgtgagtgctgcttctcattatgtctagacctatgctactcgtctttcttttacttgtactcatcatcacctctcagtttgaatggagacaacaacttgtaaatgacattgataccgctcctgccgtcgctgccaagcaccaactgttatcaaaaagggaagaggttgtcaaggagaaggtaacaaacattctcttttacaagttttacttatcttctgaaggttggctggttcattcttacgattgtttctgaatattgattagaaatggcgagttcaacatctccagttaggtttattattttcatgtgatcattgatcatccaggctgtttgattggaattttttgtctaatgaattccatcaatttctttcatcttgtttcctcgaatatctccttgaatgataagatgcgcctctttgagtgccattacagggagggtgccgtaactccagattatgtctaattgcactattctattctcatgcccttgtttcctttttcaagtatgacaaatttttaccaaaggcttctaaatgaaggagttttctatcattatgagtctaggaactaagctttcatttctttctacccaccttcgcatctcatatcgtgcaaaagaaaaggaagaggacttaatttttttccaatgtgtactcagtatttggttgggcttgaaatgcatcatattctgctagtagacatgcttaataatagtatttcagtatcataaatgtccatgtgctgacatgccatgtagtgcaactttatgtttgttaaattgcaaaaaatttgaaggatgcaggtatagaaatttacgggttcaatttcggttatattatgattcctacgtagtaaagttatggtaaatgctaacactattctagcaagtcctagaatatacataggcctttcccctctgtcacaaacaatcaaatgtacaagaagatgccctcatcaaaactcgaggaagttattctatttcaaacacagcttgattcatctagaatgaattgtatgtatagagaggaaaatcctaggattatacccaaaagctgttttcttgtagaaaaaatgtatatgagttttggagtgaataacaagtgcctatataactagaacaccttcagtatttagtctagtatgttcttggttaatggttattgctaaacttgttgggaacacagttttacttttcgcccttttagcattcatttgctgacttttgcctttttcatcttccctatgcatatgtatttgtctgttaactttaaagaattagtaggttgttcagttaatattggcataggcaacttgtttctcttaaaactttggcttgcacatattagcaggaaaattggattcatgagcagtacttggacttgctataatgtctgtgttccatgatttggttatggatgtgtctgttgcatctgtgggtagtgatgaactttttggtggttttctcaatgattatagtccaaaattaatttttggcaattcaatatttttttggtagataatagagatttgtttcttcctatcaagcaagctgttaattttctggtgatgttggcaaagcgatgtcttctttacttggatattgtaatggacagctgtaacttgacgcaggtcatcttatcccaagagaagaatatttatagactaaatgagcttgttcggagtcttcagcagcagctgctgcagtgcaggtgcaacaacgagacaacaaatagcactgctagcactttgaatgaacatgttattgagcttgaatgactgaaagacagatcctggaggattagaataggaccttgcaactttttgttccgtgctttaagtaatgttgaaactgtaaaaccttgcatgtactaacagtttgaagttcttagatgcgggaaattgcatcttattcattgtcacaatgtcaaaggtctgtcatagtgtgttcataatcattgacagcctaattatttctgataatggaatcatccttgtatacttatacactgtcctatgtgttgatgttccagcattgcactggaatggggttacattggctgagcaagagtgagagacaaagaaaccctgtcacatctaccatccagtagcttttctttccatcttcaatttatgctggttgttaattaattagttgcatcctgaaagagctgcaactgcagctttcaatttgaaccaaatgcttattaactgatgagtacaattaggccaactgtggtcttgacattgtaaggaattttctccattgcaacaacagctgtaaatgtaattgttgctttcaatttgaacgaaatactaagtaatcatttacgaattagaccaactgtagttttgacaatgtaaagaatttctcttttcaaacacaaaattnnncttttcaaacacaaaattccatccttgttatcttaataaacttcatggaggtcaaactaaggaataagaattgacaaaagttaccgaaactttcaaggtagctccaggactgtggaatgcacttaaaattgagtggttaaaatgcaataaaaaacaaaagggaagggccactttataaatttaaaggtccaaaattgacctaacacataacccaggatttattatatagattccggaagaagttaatcctgtgttcacatgatcatcagaagttagaagattgttgaaagtggtttgttgtttgttaaaacttaaaaggaaatgaggtaacggagatacataaacatagagtgagagtaagaaagagaggaaggaaggaaatatggataataaagtggtggacggagcaagcaaaatgaggagattacaggcttctcacttactaatttcagagaaagactccttacagaaaaactttaggtaattattattagaaaagggattgcgattcctcaacaagagaaacgtagcaaaagtgccacaactactggtttttatctgattacactaattatgatgatgggttggtgcaggagttttggtggattgttatccatcatcgttgctcatgaaaatatattatcacttgagtctcagtgcaagaaatgaaacatgaaagaatcttatagaaattcaaggtgtcagaatttgaaaaagacaaaaataaaaataaaattgtaaaacaaaaaaagggtcaaaagctataagtttgaatgcgccgtatttaaatgcatgagtggaaatattcgtaaaagctttaatatgaatggttgttgaagttcaattgttgattacatttcaatcttatatcatttaactatctatttctccctgaaatatcgaatggtatgccaatggaagatgtttacttacaaattgctacgtccaagctgcaaactctacttttatccaattaatttagcctgaaaagtccaagttttttcttgagatgatggtcccaagctcatcaccatcaaaacctgcacgtctatgagttttacaagccaaactaacccataaatcaaagtcaacattcattcctcttaattaattaattaatcaaagttatgtatgtatatatattcagcccaaccatccacgtcctctaacttaataaatgaatgtttgaaattttaagtgtgacatatatgacctattaaaacatacaaaatctgttatgtctcctattctactacaaatattaaataactagattatgcctcactaaaaatcttagaaatatggatttaggggataatgctaagcttaattaaaatcactttagtaaaggaagaggtaaattaatctttaaaaatagcaaaaatggaattagattctagccgacagaatttatctatttcacaataatatttctccttctggtattcttttacatacaggtaaccctaatttgagaagcataattaatagattctaggtgacttttcttcgtctacccaccattaatttaatagtcacaagttaaacaatccaataccaactgcctaaggagccaaaatcaacagcaacacaaacccttattgctggtggtgcctatatatctgcatgattcaagttatcgccattgctcttccatcttcaagctctttctagctttaagcatttctctgtccggcgcttgaacttgttttgtttcgaaaagctccctgcaacttcaagttaaggtgaaacatattttgatttagagttttatctgccaagtatttttagttatgaatttgtttttgcatgaaaacttgtactgcgtatttttatttacacgaccatgcatgtgtacagggaattaattgattaaaatgagcggtaacagtactccgaagctggaattgaagctgaacctgtcaccgcctagagttaatgatcaaagagcggaatcaccagagtcttctgctgcttcttcttgttcggaaatgtcatccaagaactcatgcgtgtcatcagaagatgcagctaataattataaaaatgggcggagccaaggaagtagttcgatggtgttggtgggatgtcgtcgatgcctgatgtatcttatgttatcggatgtggatcccaaatgccctaaatgcaacagcaccgtcctccttcatcttctcagtgacgaattctccaacaaccctccaaattaactcaatgcttcatttcatttctttcctcttcttctttgtttatttccttgttacttgaattttcctacagctagaaaacacgctgttctttctttcatgaataatcttatgtgtcgcattaaatctttattttgtctcttcttcttgtcgttgtttgttaattatatagtctccattcgtatgaacttgttggataaagtttaagctgtttttattcataattttgattgaataaacagagagaaattgatggatcattttaattgtttccaaggtagttgaaccaacttctaagtttttcaactttccagttaatttcaggctaccataccaaacccaaaatttgtgtacgtatttcgcattacagtttaaggaagtacttaatacgcagggcatcttcagaggtcaacataagaaaatctccatatatttacagactcaaattactattaaaaaaaaaaaaaagaagctaaatcataattaatacaagtttacgagaaaactaaattatatatcctccataaaaattctaaattatataactatattagaaaaaggatctacttttatatttcatttagttaaggatcatacagttttatttgtacggtattaaaagtcatacgtttatctatctctctttacacacttcttctcgtttccttgtaaagtgtatcgaatgcgagacaaggggatattgcagaatagggcatcgttttgcaccttccttcttattaaaggtagtctgatagaattcacacgcttactatctttctatctacatacagcctgcacagagcaaagtttgtaagcaaaagaacttccttcttcagatgcagcagtgaggttgaatatacagttgttctatgtataactatagtgagtccatcccacttctaaaagaagtaaacatcatcttttagttaatggagtcggtttctttgttaaatgaagggccataaacactaggtttcttcgcaccgcttctagcatggctaaattaagcttccccaacatgcataaaactacattaactctccttctgtcaaaatcccccatctgcaataaatgagtccgacacctgccatcttaagatcttcgtcgaaaggagcaatgaacattaaatttgatccaggggaattgcataatgtttcctaggtggtgagcatatatgggacggtcttgctctctgtcgcccagcatatatctaactcgtaagactcaaaacatgtgtatggaaagatatacaaagtagctgattaagtattcacatgaagagtatatactcagattcagtattcgatccattatttatactttcaaataatataaaagacttttgcagatgactagtatttgttggcatacaataattgtttttgctgttggtttatgggatgggatacaaggagacgcgtagagcttcagcttcctatcttcttcgtcggcatagtaactcatcatcctttatttatatataaatatacgttttgattatcatattcatggacgctaactattaactataatatttattaaccttatcacatttttcatgtgcgttattccaactgtgcttccttggcccttcaattgcccccaataccaatctccacctgttttcaaactagaaaaatataaattagattcactagcttattagaattaactacattttattgactcttacatatcactatatcatcttttagtgttaaaaattcaacaattataaataaaattattaaattgttaaatttttctgtttgattatttttattttataaaattgtttcatttttattattaaccattttttataagattgaatgaaagagagaccaaatgcagtgaaaaaggaccgagtcaagtcctggtggtggcagtggggaatggtatacaaatccataaaaaaaaggtaagttgatgagtcaaaattcacaacacaacgcgttgaaccattgaacttaagccttattcccacgccgtcacttccctctctttccaagcaacatctcactcctccctctttcttatccatatttataactccctcctccttattttccgccaccaccacttcccactttccgctccacttttcttttcccttttcttcttttaaagtcttccatctcttcttttcttctctcaggttcggataggatgattcttcaacactcgagccgctcggtctcctccaaccacaataaaccagtcataatccgtgacgtctggtcccataatttagaatcagaattccagctcatccgagacctcatcgatgacttccctatcatttccatggacactgaattccctggcctcgttttcaaaaacccccatcactcccgccgcccctccgatcactacacactcctcaaatctaacgtcgacgctttgaatctcatccaggtcggcctcactctctccgactcccgcggcaatctccccgatctcgccaccgctacccgtttcatctgggaattcaacttccgtgattttgacgtctctcgcgacgctcacgcccctgactctatcgaactgctgaggcgccaaggtattgacttccgcagaaatacacaggaaggcattccttctgccagattcgcggagctaatgatgtcctccggactcgtttgcaatgactctgtgagttgggtcacgtttcacagcgcttatgatttcggatacttggtgaagatactgacgcggcggtcgctgcctggtggattagaggaattcatgaggttggtgaaggtgttcttcggagacagagtatacgacgttaaacacattatgaggttctgtcacagcttgtacggcggtttggaccgggtagcgaggacgctggaggtggaccgggcggttggaaaatgccaccaggccgggtcagatagcttgctgacgtggcatgcatttcagaagatgagagatgtatatttccataaagagggcccggagaagcacgcaggggtcttgtatggattagaagaagtttattgtttttgacgtaatcaattggattattaatttgtttaaactaataaattacaatttgtttattaaatgattaaaggaattgttttcttttaattggctaaatgcataaggaaacagaaacagaaagaggaatgtccttggaaactagcagtcgtaattcagcaataaacttccttgctacttgaattcttattaaagagataggttggtaacaaaatgccgacccataataaatagggtgtaattaaaaatgaaaacttgattcataaaacaaagaaaaatgaaacaggcattccatttgaaaaaaaaaaatactaaattaaacaaaacattagaagataaaagtcacacatacacacgcctcttgcatcaaacccgcaaacatttcttatcaacaaatgataccgtacctttaatttgtgctaaaattaacaagcaacataaatagaagatggaaaaagagcttctaaaatggatgcaattactactgcactctcctcagtctttttgctattctatctatccttcaccacccatcaaattaatggttaaaagaacatcaacatcaaaagttcaagaagctgtcaacatccatcaatgttgttcagacaatgcactaaaaaaatggaagaagagcaacctttttttcctaaggaagaaaggtcactccaatccttcccaaataagaattagtcgttatataggacataggttgccgtaagaatagatcaatagggaaccattgatcatgtaagtatatatagatatctttgctataatgtaatctcagaattctaataatacaacttcttcatagattactcaaattcaacatggtatcaaagcatgtttcaaacctgtgaatctcaatcaaaaccaatcccacaagtttttcttttctcagaatcatatcatgtctccaagtgacaacaagttaaccagcataattctgaaaggtaattaaaattattttgaatggtcgaaatcagtgtatattggtcttagtggcagaaggaaacttgggttcatcacaggaaactaaaacccaaatcagaaaggccagaggccccaaccgaagaaaaaacagaaaagagagaagagtggcaaacaacagaccacatgatcatgtcaatgctaaccaacacaatggagacccaaatatccaggctctgtatattgctggaatcatcacaggccatttggaaaaaaatgaaaggcctatacgggcaccaacaaaattttgcacatattttcaatctcaagcaagaattggcacaaatcatgtaaggcacaaaaaacagctcagaatatgtaacaaaagttctaacccgatagaaagaactgcaaaattaccttcctccaacaactgacctagaagaaatatagaagagagcagaacaggatttggtgtatacttacctgggaggattcaactcaagctacgaaagcttgaggtcacaaatcctcctgtagacagaactcccaaagattgagaccgtaatagccaatattcagcgagaagaaattcacagtagcctaatgaacgcctctctctctctcgatgctacagaaaattaagcgtgctccacttgacgcttcaccacccacgaacttgcccgactgaggggaggacctagcaacgtcgagcgatgtgaccattgtaaaaaatagggtcactatcgcgacaattgctggcatctgcacccccagctgaagccgactcggggatgggagaaaggaaacaatactggagggacgaagagaggagaaaggaattttggtttcagcggggctgctggaagagaaggaaaataaggaaaccctaatgaaaaaggcaagaatgaggcaacatatgcggggttcgaaagttacacttcaacccgaccagccaacccgacccggctgtagccaccatgcaccttacccaattactatcccaaattcaagccctgcttcaacaatagtcagatgggtcaggttcggtatcaaactcttctctaaaaattgctaacatctgttaaaataaaaataaatggattattgattccaaagccatcgattacatgacttggaatccaatgaacttgcaagattttgcccccattgccgattcccaacatgtgttggtcgctaatggaaacaaggccaacattcatggccaaggcactgccaaattatttaacagaaaaatacaaaatgtcttgcttctacctgattttaaatcaaatttactgtctattggtaagataactcgtgatttaaattgcaatattatattctcaccatctacagtacaattttaggaccgaattacagggaaggcgattggtgaaggacgattagaaaacgtgttgtattatcttaaggacctaataagccaatgcctcatgtcaaccaatcctgtcaatcaaggcatgttgacgcattggcggtttgggcatccatccgatcctatcttaaataaactattttattataagttaaattccagtcattgtgatgtgtacaaattttctaaacatactccattactgttttctttatcttttactatttctaataaaccctttgaactaatccactctgatatttgaagacctgcccctgttgagtcttataatcattacagatactttgttatatttattgatgactacttccgcactacctgggttattttgctcaaaggaaaaaatgaggtcatcacctattttcaagaattttttaactttgttaaaaatcagtatgctgtaaacattaaaatttttcggttggacaatggcactgaatacatcaacaaacgcttttctgacttttttaaacaagaaggtattttacatcaaactacgtgcattaacaccccttgaacaaaatggagtttctgaaagaaaaaacaggcatcttcttgaagtcacaagaactctgctttttccaaaataatgtccctaatatttattggttagatgctattcttaccgccacatatcttatcaaccggttgccaagtatcaccttacagaatctaagtcccttagaaattctcaaaggacggaaaatataattaggacacatacgagtctttggctgtatctattacgttcacatcaaacgacaccacaagtttgataaatgttctgataaaccctatttttaggatactctttagaaaaaaaagggtataaatgctatgatcctactactcacaaaacgtacatctcaagggatgtttcttttgtcgaaaatgaatcttgttatacacatcattctcaaacccctcaattacacactcatgggccatacactctactatttccgcataattttgctttctctaacaacagtaatcaagaacatgatgctcacttagaaggggagctaaataccaactcaagcacaattccttcagggggaggaagtgaaagaatcaagctagaagacgaatccaaatccactcaagaagaagaaatttccttgagaagatccactcgacagacatacccccctgcaaaacttcaggactatggtttccataaggtatcatatccaatccaacatttcattgcatatgatacgatctcgagtcaatatcagacatacctaagtaatagcataaatcacactgaacctacatccttttaagaagccaacaccaacctaaaatggtataaggccataaaagaagaactccaagccctataataaaacaacacatgggatattatgcctctactactaaccaaaaaacctgtagagtgcaaatgggtatacaaaataaaatacaaatgtgatgggacagttgaaagatacaaggctaggctagttgccaagggattcacccaaacctatgggctcgattactaagaaacttttgcccatgttgcaaaaatgaacactgttcggattctactatctgtggctaccaacctgggatggaatctatttcaaatagatgtaaaaaacgccttccttcaaggtaacttagaagaagtttacatgactcttcccccaggtcataaatccacatcagactcttcgctggtatgtaaactaagaaaggcaatctgtggattgaaataatctccaagagcatggtacgccaaactaagccttttcctctttaatgttaattttaataaaagcacttcaggttcctttatgtttgtcaaacatacacacatacacacacacatactattgttgttcttatatatgttgatgacatcataataacaggaaatgacaaccaagaaattgaaaaggtcaaacaaagtctaaaaagggaatttgacatcaaagacttagaccaattatcatactttctcgaaatagaaatggccaaatcagacagagggttgttcctatcttaaagaaagtatgtccttgatctactaaaagagattggaaaaactgggagcaaaaccagccaatactccaatggaaactaacgttaaacttaatctgaaagatggtgagcttgtctctgacatcggacaatatcaacgcttaataggtaaattaatctacttaaccattaccaggcttgatattgcatatgcagtaagtatggtaagccaatttatgcacgctccccgcaccagtcacttggaagctattgacaagatacttaggtatctcaagggcactccaggtcaatggatctggatgaagaagaataacactaacactatagttggtttctctgatgcagattgggcaaaaagctacgatcggaaatcaactacaggtttttgcaccttcgtaggaggaaacttagtgacatggaagagtaagaaacaaagtgttgttacaagatcaagtgcagaagctgagtatcaagccatggcatctacagccagtgaactcacttggatcaagcaagtcctccaggatataaaaatcgaatgtaacgaacatatgaaaatatactgtgacaaccaagctgctcgacacgcatcaaatccagtatttcatgaacgaactaaacatatcaaagttgactgtcatttcattagagaaaaagtacaatccgagaaaatcgaaacactgttcgttagaagtcatgaacaactggctgacatctttacaaaaactctcaataaaacaaactattaaagaatccttaacaagttgggttccatcaatctatacgaagccaacttgagagggagtgttgaaagacaaacatagaacacaagacaaacataaaatacaagacagaaaagctgtaaatatgggcctcaggtcatgtcatcacagacaccaaaaaaagagaagaagagctgtctttcttccctaagaaaaaaaggtcacttcaatccttcctaaataggaattagttattatataggacatagactgtcgttagaatacatcaatacgaaaccgttgatcatgtaagtatatatagacatctttgctataatgtaatctcagaattctaataatacaacttctttatagattactcatattcaacaataaataattaacattattagtattgtcatatataaaaagtaatattatattttttaaaagataaaaactatataaggtaatccttacctattctcagagtatgtgccacagtaagtatatatgtatatatgtatatatgtatatatatatatatatatatatatatatatatatgtatatatgtacttttaacattgaatgattaacacttaataaattaaaaaaattaaaaaaaatatgtgaattatttatgaatagaatatatggtgggtatatagtgtaaccatccaccgatacatcttatatcagattttgtcttcaccgatagtaattagttttgcctgtcaaaaccactgttttacattaaagaaggaaaataattagattaatggattacatgtgtaattctccacccacggcatggatcgtttctgtgtgcttgtttctccaatctcgactaattaccattgaaatcaatggctacgaatactaggcacagctacgagtcgtgttattctcctggaacactaggtttctgtggatccatcagctttttagagatgacatcattccagatctcagtgaaagcttgaacgattagaccatggtgacgcggagaattcagctttagaaaacagttcagaagctcctgaaggtcatctgcggagtatatttccttctcaaagatcatttgcaacatggaatgcttgaaatcttgatatgggtcattagaatctttcaccacagcgatgctgttggtgattttgttcgacctttttggattggtatcatcagattcggagttgagttgtggaagaatgccgctgtctattgtagcggtaatggaagtgcaactttctccatcgcctattgagaagactccatttttatcataagagcttaaagaagaagaagggtttggatccctgagagaaatggtggttttgggttcatgaacatctgaaggttttggcctggcgcaggagcagcctgcaccgagaactgttttaaaaagcttatttgtcttgcttaagggcattgcagaaggtagtggctagattgagatttatgaatgttatagagaaagaaatgttgttggtaggagtggttttcaggacaacaaacatgggaaagaaggaagcagatgtatttggataggagtcattctctatattgttttgcagagaaaggaaggtttgtattagacatttgacttaacgtaggggatatacatatacactctttacagagatgagatttgagagagttgtgattatgccgataagatcgatgtgatttgatcaatgatctttatctctaacctaatctgatagcttgaattagttaacatttaattaatttaaatgaagaatggatgtatgctttaattatcaaagtatgcatgacaatggatagtaatggtacgtaaaaaggtgtcaattagaatgtctactgttcgccattatttggattattagttgaaaaacttgttaaaactttacattgaatatttactgactagaaggattttgtatctcctctcctaaagcaaagtcattaaattaaatacttggatggatagtgctaattaacttgtacctgtaaccccatttgcttaaccagctattaacaatttcgttgattcagtactatgaatgctttaacattaaatgtgattaacaactccagctgttaccagggttcttttccaattcctttgatctgttacaatttagccatctatgactatggagaaaaagagaagccatctttataattaattttctaaagaaacaccaaacacatagtacataaatgtatttagcaacatgtaaacagtagaagctttgtataactcttttttgtttatttatttgtttttgaaagaaaaactaaatatttacaaggtcagcagccatgcacaagggtttccataatccctagctagctagcttgttagaagaaaaattgaaaaagaaaagaagaaacaatactaacctaatgcaacatcaaatcaagtcgaatgggtcggtccaattcagtggcgcatcagaaaacatataaaaatcttggtgagaaggtgattgtggataaaattgaagcaggtattaataggaggcttgagtccatcccagatgagacgtaaaaaatacagagttgaaaaccttgcagaatcaggagccgtcatcccagtaagatcacaaggaatgagatccttcagtgaagtatacttcaaatccaaggctgattcacatgtcatgataaggttgtcgaaatgaggtacttctgtttctatttcggaagtatacttcaaatcaactgtttctgtctcggtctgcgattctgtctcgaaataacaatgaacagattcactgcttacaatttcctgcggagataataaatccttcaacgatgtatatgtgggattaaatgatgagcctggaaagcttttgctcagagtgttgctactaagaaatggaaatctgctcatctcagtagagtacataaccatgtgtttccttttctgggtcacttatataataagattgaattggcatataaaagaaaaacactgcttaagtggttatactttttgtttttgaaaaagttcgtaattgattagaattgtagattaagttgatctaattaatataattttattttctggttgttgttatccttttattagttttataagtagagctttttcagaccctttaaattgcaagctactaacatttcttttttttagtttaatgttttatttatttatttttaattttaaataattgcatttgtttgaaacctttttatttattttaaatacatatttttttctaaaactgtacgtttgttgtaaccaagaatgtaatttcagaaatcacaaatgctttttagtttaaaacagaaaagaaatttcaaaaaaaagggtcaatcaaatggtaaccactatatccttttattagagaaccctaagcagatggaaatacaattagatcactgttatcaccaaatgaaatagtaacgatgaaagattttctgaatataaaactattttgattttcagcatgcttgaatattgtaattaggaatataccaattatactactgcatatagtgtttgaggatgatgatatctcaactcaactcactggtttaactttttgacacactttggtattgtgagagttaaacctttttttgggtttttggatagaattggtaagttcgagaggcaaagttgcaaaaaggcagttgctgtagaattgcagtccctatagtatctatcaatcaacgtttgatacttggcgctttagctcaccataagtttccctaatagctcagccaccaactcataatgaccaaaatggccctaaaaccccaagtgaatagtgatgccttagcccactacaaaaatggcaaaaaacagagtgactcgcaattcttgagggtactcaaaataatataagactaaaagtactctctgcttaccactagaacatgtgtttactttggacgtaaaccaacacaaccgaaaaaaagaggctttggattgggtaaaaaatggcaacacctctgcaactctctcctccattccctgctgcctctttcctatctaacaaaaacttttgcaaacattacactggctctcttcaacctctcaaatccacttttaaaaatttcagcaccagagctatcaaagagaaaaccgattcttcttcttcttcttcttcttctgctgaggatatcaccaagaagtatggtctagaagccggtctttggcaggtacccttttgcttcatcccgtgaattttaacttccatcgaactcctttcttcttgttttcttttttgaagttttaaacttaattatcttgcagctgcgtttctaaattcatttatcagttgattatatgagcttgagattatattcctacacctgaatttggtttgccaatatgatatttactcaattcgctgcaaattgttcttcaatatactgttgatgatcaattagcttttgcacaaaactcaacgcagtttcattttgttgctctcaaatagtagcattttagatgcatttccaatctcgttattacaagtggcagaataattcaaagaccaaggagtagttactattagtgactcataagatgagaggaggaagttcgttcatttgcgataatggttttcttgaattgtattcagtgtcaaagtatatgactgcccacaacaaatagttttagctcaatctcaattataatttgaaagagaagaaaacccccaactctaagtggtgcttccagaactaccagtaccaattttattgtattactaattgggatggcctcttgtttccaaaatgctatttcttaagatattcagcacaaaagaggagaggaaggaaggtgatggtgaaacaaaaaaatcaaagggagaccaagccaaggagctgctagctaaatatggaggagcatacctggccacctccattacattatcctttatctctttctctctctgttatgcactcattaatgctggcattgatgtccaagcactgctgcaaaaggtaaaacccaactcttattacttgatatctcacaaagcaattgatttgggaactcatatatttgtattgaaaatattcaggtgggaatttcaactgatgcgactggggagaaagttgggacctttgctttggcatatgctgcacataaggctgcctctcctataaggtttccccctactgtagctctcactccaattgttgccacttggatcggaaagaaagtcgataaagagaaggaaagcccctgaaatcagtgacctataaccccttttttttttcttctctcttttttactgctacatttgtcaaaggagacagagattttccttttctttcttcagaaaatatgtacgcttgttggtccacataaagtaaaatcttaaagttttgaaacttgaaactagccaatacatttaaatgataccacaggacatagattgttgaatgatcctgttatttatgccatggaagcaccaaacaaaagtattgtcaattcaaaggaaaagggagattgcagggcctctatatcacctttatgtacctccagccttgagatttcggatataaagtagtaactgcacaaatcaatggtaacattgttgaggtaaaaaataataaaacaatgctttagatcataactcctccagctctaagcaaactagctattgcttgtcatcacgtcatatcttatacaacctaaatgcctaatcacatgtgctgaatgtaacaatgctgaaattggaacaatatacaagtaatatgcaatgctaaactcaaaaatacactagtgaccttatttttcctgggaatacatggattgtgtgttttactggaactgtacaatgcacgagctacttccttttctctggccctcgggacttcaaggatcattatgataactcccagaaaccatcggtccaactacagtttactcgcaatgcttaagggagatgcatggagccatcgatataataggctctcaaccaaaatcaagcccctctatctttctccatttagcaacatcttcatttcatcctgcagcagtgttagcattagaaggaacttctgtttgcattagatggtggagtttgaggtctggggtgtgcttgcatttgctatgccatagtcatcatggagtgtatcgaattcgttccactctactccggctatatttgtgggtcaaggagttcagaatttaatgctaaatatataaatcgtacaagaataacaattaggcaaaaataatgcattgtcagcaaggatacgttcagtacgccacatgtctgttatactaacaccagcatctgataaaagccagtnnnnnnnnnnnnnnnnnnnnnnnnnnnnnnnnnnnnnnnnnnnnnnnnnnnnnnnnnnnnnnnnnnnnnnnnngaaaaacccatgttcaggaccaccaaaaaaatggtatttttggtgcaacaatatgaactacatgccagattccaactattctttacagttttcatccttgcagaagattcaaacaaccatccaaaacaaagacgtgtccatccttgtgagaaatcttgatatgtccagcaaacatagaacagcaacttgcattggagaaagagctgaaaccaaataagaaacttacatctacatctgagggaacaatcttcatgatcccactcacaaagtcctgtgatgtgctaagttctgagcacattctctgagcatcatctccctgcatttcaatctcctttcctctaccatcctctggaaccactgtaggtgctggattttcattaaaacttgaacttgatggataagttggaggaggttcagcaccatgaatctcctcgaacttctcctcaaattgactaagataacaggagagaaagagagagagatgagaaaacttgatcaaaaacttcgaaaagaaaaaaacagtaactcatttttgtataccatagcagctatataaaactgagattaaaagcagcagtacctgacaagataaacatctatcggacccattgtacttctgagaactatcctgtatctcctctggggatagtcaacagcctgctgcagaaaggaaagcctgtaatgaggaatatgcatagacaaacacattacctacttttcttagttgacagctgctcgaattacctcatccggatctgggacttccagagtggttccatgtggagctttaattgctattaaggtttcattctgttcatatcaacaaattatatatgagagagagagagagagagacagacagagagacagagagagattgtatagataatgcagttacagtccaagcaccaaaacaaaagcttatgtaagagtgaagcaaagaagaaccaacctggaagcatggtaagctcttgatgtcttcctcagtgacaaaaagccacctaagatggtaaaaacacaaaatgaactaattccatgcatacaaataatgagtattatataagtagctgaaatttggtgcaaagaggataagattctacttctgattattttcatcttcactaaggtccctcaatctttcttgcatttctctgcagtaacataaagcatcagtacaaaccaaaaatcccaaataagcaacacatgtgggttgcataagcaaaaggaagaattacataaccttatttgttcatctaatctgcgttcatcaatgttaaggttttcaacttctgcctgcaagcaaaagaatcattaggcataaactaaaaagcttgtatcttagaaaggtttttaaatttcttattttaagatctaccaatgggcaaaagaaatagtgcatgacccataatcttttaaaactcattgtgatagaaaactatttataactgaaaaaagcttcatcctaacttactatagcaaatatcaccctacttatgctgcacagtttgattttaaatgtacgctattacattgaaaccatgaccgctgatgagagatagtccctagcaaagctgaattagaacaccggttcacagtcaactccaaatggtgggcataaagatgctacacttgtttgattaaataattaaaattggctttccattaaaagagcacttctcacttctcacttctcattcagatcaggtccaagaatgcttgcaagtagttacggaaacatttcaactatggtattaggaggaaaaaaataaaaccaaaacaaaagaaataacagaataaaacatagaatacaccattttgaagagctctaaggttttccataagaatgcatttcaagaagcaaactgtcaaataattgatacctgcaaactagcgacactttcatctgcttcccctggtcgtgagacatcaagtcccctgatatcaataaggtattcagtttagtatcaggtggaaaattagttaactagtatcctcccaaaaaccactacttagacattaaatgaaatcaaatgtgggggaaaagaaaagaaagaggttgaaggagaaaaagaagctaaattcatacttccactgaattctgttcttaagcttcttctcgatgagaccaattccttctagaacatttgttatatcatatatccgccgcttttgcacctatagagagaaaatttcgaatgctataacattaaatgcaggatagaatgaatttaaataatttattgtcacctctaatgtgtcagcagctttgttaagatcaagaattccatcttcggcatgtttgatcaaattgatgaacttttttgttaaaagacctaattcaagatcagagaagattcttatcgatcttaagatatatctcttttattccaaaatctatttgaacataatggtatcaacaacaatttgaaaatgaacagataaattcttgaagaatgagggtttacccaaggagctgtcataacgacagggaccagtaggagtaagattatttccaggagaacctgttaattgacaaaatgtttatattacttgtcctcactttcttttcagtagaagtagggagaaagagagggtttcgacaatgagaaagaaatctaacaatatcaacccatttattgatccagactaagttactaacccaccaataactaagagaatactctacacaattacaggaaatcaatgcagagactttactatgcaacacaccgatatttgaaccggcattctgagatcctgatctattgctcttcgaaagccttgatgttttgggaacctttccactttttccagatacaggtgtctggagaggactgttaaccacttccatgtatccaggaccagtattccatgcactggactcagcaggttcatgatctgctgcatcactcttccgcttcagtggctgataaacaccattggttgttttagaccataattagtaatatgtacatcctaaataatcacatgttacgaataaagaagtaaccacagaagttaagagctggtaccccagcaaaggttaaagaatcataatcaacatacatgcacactgactataaatttgagtgcatgcaagtgcactggatatatgttagacaaccagcctaatacaaacaatggaacccatgcaaccaaacagaagaactggaattaaattcaacttattaaatgaaaactttaaaaaactaaatgcatttaatcttctgtttgtcatctgtgttacaaaaataaggtattttaatttcaaggcactaaatattctctctctctctctctctctctctctctctctcactcactctctctctttgtcatctgtgtgtggaagcagctaaactagtagtcataaactactctctcttagctggtgctaattggttaatacattttcagaactaatccatgaaaaaacagacaagctaacttcaaagcacattaatgtcgtcaaggcagtataaaaattttgatgcagttcttcaaacccataaaggaaaataaccagacagatatatcaacctcttcttgataaataacatcttaaatctttttgtgaatattgcctccaagagattaatgaaataacatgtacaacccaaatgtcattacataaaaactctcctttgcagctgacagccagctctaatgcacctaaaagaatcctcacaaatttagacgaaaatagatgcaattgaactcaaagcatcacgataccagtattaaacaacaggaaaacctggaaatggcatttaaatttacataataatatctctactcattgcagtatcccatatctttctgagcataaatgattgctttaacctcagaacattcttgctgaaaatgaaattctaatcataataatttcaagagatctacaatcattcctgagtatggtaaataagaagtccaagcaatctgtcaccagaaatccaatgttttaccccctaaaaactgttttggtacagtacagcacctgccagtttgtaataaccccttgaatgatattataaatagaggtcagcccgaccaacaacttctgaacagatgaacttctgacagtttgcctttctgaggaatatgcggagtatctcttgtgtgacttttgagagctgaccctgctggccaatatttcctcaataaacaagcaaaactagggaagaaaaaagaaaaaaagaaaacgaatgccacatcatataacctcgtcaaaatgaaaatggggaagtgaagagcacaaaaggaacttggattatggaggtcagaaggaagaggtagggaaatggatgcttgactaaataatgagaaccaattaaaagaaatcagaagattcaggaaaaaaagcatacaccattataagccttttctcatccagtatcaacatatagaaagaaaatctagataatgcaaatgatgctacacaatccgtcacaataataaatataaaattccacggcgttattaatgcaagcccgtaattgaatgagcagaccaagatgaaagagaattcagccacgaaggctaagctagaaaccaacccatcaccttagcgtgaatattaagaaataaatcattatagatttagtagatcctgaaagaacaagcaaaatgcagcactttttacttaatcagagtcatcatctcaatttgttgtagacaatatgcttgcaagctaaaataaacataataacaaaaaccatggccttaattcaatacatgacagcattagcaaacatttaagaaaatgatgggtattcaagtgatggcaaaaagaaagtaaaagcatagcaatgtagtctttaatggaataaggcgcattcaaaatacaatgtattgaaacttcacctcttagatttcatccaaatatgataacttgcaaaagtgaaaagaaagaaaagtagcagctgtaatacaaaaggggaaaaaattaattctttaacttaaaaaggaatcagaaatcattaatttactcaaatcaaactacaccatacttatatgtatgtgtgtacagctcattggaaggtttctttcttaataaacccaaggttctcgtggatcctcaaaatagaacataaccttaattaatatgaaccattttgtatcatgtaattggtcacggtttatccacagagctaaaatagcaattccatttctagttattgagattcttgaaattttcctattatatgtactaagaagtagacatgccgtgaaattaatacgagtaccagaactaaaattaccagaatattcccctccatgctacatagcaggttcaatggtattattactcaagttgtccaatttagaccttttaagtcttccatttaaaccagcacccttcattcatagattttgcaagacaacagagggatcacataccttattcctggtttatgtagtggcaaaactataataaactctgacaatggcaggacattataaacgacagctatatctagcctagttgagagacaaagaggatgcttaaaacattctactgcatttacctttggctagggatgctatagcaaagataggaaaggacaatggacatatcaatggcatgttatgccagaaccaactaagatcagtcttctggagattccatataaaagaaatagaaaggaaatacaagagaaggtatcaacaaagatcagcattgctgcctctttatgatctaagtagagaacacaatattaagtattctctctctctctctctctctctcacacacacacccaaacccacacccattagcaatgactatctcatttaagaaataaaaagacttatggactcataacacaaaacaagttaacaggaaatcagatattccacccacatccaaacaaggacatcaaagttccttcatcattcactctttgttattctatcataccctgtgatgtcatgaacattgaagtaacttccatggaacaaacgagaggagcatttaagtgggaaaaaacattgagctggatagcggtagaaatggagctcaagaattgaagaggataaaagaaaaagaagaaaatagaaataaccaaaagaactaatgcaagacaccctggataactccatcaaacaacaatatgcatttgcttaataacactggattgacaagttttatgctttcccttaatcatgagagaattttcggttataacagaactcaaactcagaattgttggcaacaaataaaaagaatactagtgctgttgcataatgaagcagttgaatgccggtgttttaactttacacatcagtaagactttattaccaatattgagaggtgacaattcaacaagagaaagaaatcggcagcaagtgtacatagttttctgaaagaaaacgttttgtcttgtccaaccctccgtttaccttttaataagtagaactgattcgctaatgaagcagacaaaacagctaaacttacatgcttaagcaaaaaatttcataaagctgatactcttaattaaggtgaaatatagcaattaagcagtgtaaagtagacaacaaattaagaaatctattttataagaaaaaaaaggaaaaaagaaaatccctttccctccaagaacataaaatcaaactgaaaaaagaaaagaaataaaataaaaaataaattctgagggaaagacgaaaagcgaacattaaagacaaaggaaataaacaaaaagagaagtgataaaaatgcagaaagcaagtagatctccaaaaaaaaaaaaaaaaagaaagaggaagactcacaggaggaggtttaacaacgatggcttcaacttgaggaagagggagccggcgagggtcagtggtgaagcggtgatagtcaccgggaggcaagaaaggcggcttcatagaagagaaagggagttggcgttttaaggaattctggacagactggggatttggaggttgcgaattcgacatctgacaaaccgggaaaatagaaaaagaaggaaaaattgaaaagtgggatctggaatcgtggaattggggagggggagggagagatctgcttgtgcgagtaattggttttagggaagagagggaaatataaaaaataaaagaaaatgaaaaaggaaaaaagcgggagagagaaagataggagaaaacgagggaaggaaggaattgggttgggatataagatgtggagggaacccctttcctcattttcagaacaagtaactcggttcaatttcattctataatcacacatatgaatgtgttattataatagaattaaatcaaacacccactggatatgatattaatatattatgatcagatgattatttagtaagacactcagtacaacccccataaatagacatttttcttttattttatcattttatgagaatattaccaaagataaattattcaaaaaagaaaagagattaggttcgaatcgccgaaacgcgccttttgtagcgtaaccgattatttggcgcgcatttcttcagtgtgctcaccgttaccaaccacttactccacttttttatcatccattctttgtccttgatgcctttgggctgggctgggctgggctgggccttaatcgatgctttttctttttgggtttacctatattaatgcattgtttcatttggcgggtaaaagaaaaaggagtggtttgacaaatcaagaaaataaaacaatgagcttagactattattaaatgatactatcgcatcatattttctatcaacaaattgcagcaccgctcataaaatcagatgcgctttcctgatgaatgcattcagctgccttactagtctgtgttaaaagaaatcaggggaaagaaatatatgcatatattcctatcaaagatatatatctatctctgtgaatgggtttggacaccagaaaatggcaacccatcaatcaagcaagcacagttaccatgcaaaattacaacatcttccatgactttgcaagacaactccacattcaacctgcgaccatcaatttcaaacttaattcatctattcatatcacatatacccagccacttgataactcaattaaagtcgtagttggccttttcggattggtcgcggtttagtgcttcaaatcatcgccacatattgacttgaagaaagcttatcaagagagatggaaaatccacgacaaagaaataatggctcaaagtttcaattcttttcaacatttgcagcaattttaaggtgaatagatgcctcgggattgtgacataaagcaagaaggcagactcatctctagcagcctctaaaccaaacaaacaaagtttttactttggcatcataatgcactctttttttagtagcatttaaatatcttgtttttaaggtaatattctttttcgacgagcaacttctttgagaataacaacaagacattcctaatcgcagaaaatctcaaactaagaccttgtaaacacacagtgactcaatgatcaaccacttcttgcatcaggtacagaaggtgaagttggattacagcacttaaagaggagtcatcttttggggaaagaatagcaaccttactgcgagcaacaagtcaccacttacctcatgtagaaatcattggacagggccccatgctcgcaattacaccgactatacaaacccacaaactgagaaagagcatgtgaaggtccaataccataaattttcctcatagcacattatttactttggaataaatgagccagatcaggatcgtccaaggccacatctatccatccattcaagcgcatgtattcaatataatgatctggtggttccactgccctgcaatttctcggagtccagccatgaatcatctcaacatcccgagcaagccactgaatataagcacggtccacaggaggaataattttcagaagaatctcttccctttcttgctttacagtcacaggcttgtttcccatggtgcgcgaattttgcaagcttaaggaagagcataaagcaataaagcaaattagtgaatgaaccgagcaagataaataaatgtagaaacggcgtggtttatttcatcctatacttgcctgcttgctctaaaatgttaaaagtctcacaaagtagtgcctacgcagaaataaaagaaataacatacatcatagggagttcattaatttccttcaaaataatatattaacaataccacttctctgaatcatttactataactatagttgagaagtctagcataagaaatgctaataaatcatcacaatcacatcaaacgctaaaaacttgagccacattcaagacaagaaccagtgttatctcacatgctcaaaccaaaaagactcctgcagcataaagtataatgacttcagcattgtggtagggaggatccacacatccataagaaatttatttgtttccatcattccgtgcattggagtatttataaaagaaaaggtcaatatatcaaaatcccactcccaaaaaagacaatatatatatatatatataagtaagatggattaaaaagaaaacagcttgaagagagtcttgaaggaagcaactgaaatgtgatggacaaacaaagaaccttgcgggaaaaagcttgaactggcaataagttgctgaatgaaaaatgaacttcaccttatagtcataagcactaaagtgagccatgttgcacgaaaagagtggtgggataggtgtaacatagttttgaaaaagtaagcaggatttgtaattaagcgttaatgaaatgtatcaagcaaggatggcgttgacagtagcaggatttgcctagtatcaaatgcaagagaaatactagtaataaggcatcccaatcagattctaatatcgcaaagagttcaaagataaataagtttcctttaaaaccaacaaaaatttgaattttactttggtagataattttgagcaaggataccaggcacccataaaaagaataggtaatggctttggaaaaactttttatagattcagcaaacaaagtgaagaaactgagtatatatatatatatatatatatatatatatatatatatatatacccgaacagtgaaagaacaaagcaattaaaatgattacagacatctttacagcgtagggagatcaaaaccaaatcccaaagttcccaagcgtagaattctcaagagttcgaaacatagataaaaaggaaaaaaaagaaaagaaaaaaaaaggttaaccgatgataacaagtcaatgataatcaatatagattatcacgaattacaaattaaaagaattttgaaaaactgaccttgttgagcagagcagtcgaggattagagggtagagaagagatgaactgagagagagacagagaggcgcctgtaaaatttactaagattcttatttactaggatacccttgcagttctttggaattacaaaggtatccttgcagaagtagcgcatataaatattcttcaagacctaggccgggtttcgaggtttctacacactgcccttgctgttgcccggaagcttattgtcgcctttcaaattgagcctctctctccatcaggttctatctactaatcacttctattttttttcatttttttaacaaaatttagataatgaactgtaagttagattcttttatacgttctgaaatcaatttgttagttgcagttgaggtttttaactgcaatggcggatagaaatttgttgctatgctggtctgtccagttatctcagattttcaattcctttgctaatctgaactactattgttttttggggggcagagaaatcgattgagatttataagcagtcttgcaaggaagtttctcacccaacttgtcgctaatgtctaccggccctggactcgagtcccttgtagatcgtatgttaattcttcaagaccttcctcttttccatttctttcacattattatagtttttaggcattaatcttatggaagcatttaggccttggggagtgatcccagctctggccttactcattatcctctttgagctgtaaccatttcaagctttcatgtggcaaattatacgaacagtcatctgataatgtttaatttaaactgcttcgaaagcatgttaagccatttataaatcctttacaaatgtattaatgtggttaatagactggtgtacacacctctaatatgacagaaaattactggcatgatcacttaaaacaataacatatcataagggacttagagattaatatttctttactagcaaacgaaccagagtttagtttgtagcattatcttgtaaaaggatgggctttcatgagttgggataaaacccggtagatgcctggcctctcatgagtcctttgcttttattgccctattttctaccagtatgccttgccttttgtttccaattcattcaggtttattcatttattcttgctgagaaagaagctaggatatacttctccatgatctcttgcttaagtggcattattcttttcagttttgggctacatatctctacttctatcatagtcatccagtaataacttccttgtcgtgcagaaaatatttcagttatcactaatgatggccgcaatatagtggtatgttgtattctttttgccctgtacgtcttcaagacctatatttattaagcacattattcttattctttatcatatcatcttaatcataaagagctttctaattcagggaatcctgaaaggctttgaccaggccacaaatattatccttgacgaatcgcatgaacgtgtttactccactaaggttcgtgtcattgttatatctaagaatcctccaatttcagtttgttcctatacccttaatgtatgtgggattataggcacttctagcactgaatgattcttggtcgtgtatagattaatgtttaagtagtggaatttctctgatttgaatgtataattctggttgaaacttcattcacttatggattgaacaacggaagataattcgttcgtcttttctcactgtatatattaacactacttgattgatttgcaggagggtgttcaactacatgttctgggactgtacataataaggggtgacaacatgtaatcccgcctttgctgttccttgttctttgtttgtttgtttatttacttattaattaaggggaggaggctactgtttctcagttcccttacttttgaaatatattatttttttgaaaaaaattgttggatttgattattgcagaagcattgttggggaacttgatgaagaactggattcgaatcttgacttggcaagcctaagagctcatccactgaagccactcatcccttgatcaaatatgaattttttgggtggttgtggagcagataatggaccaagtatagtttgttacaaaaatatgatggccattgtactaagttggaaggaagtaatgatattattattattattatttcttttcttttctttccttttacttattttcacaatgatgtaaggcctgatgattgtgagccgagaactatgttagaaatagcaggtttcctctttaattttgtaggggatttgttctttcaggaaagttgtggccaagttcaaatctccttaacgaggaaaacaagttccatttcagcagaattatttttgcaacagtgcctgatgcatccatatacttaattgttttgtcatttgtgggcttgatgcagcagtaataataataataataataataataatagaaagaacttgaaaagagcaacacctggaatgcttaattggtatatttatgtttccattctgattgaattagcaaaatgagaaatagtgcacaagtcagtcaatcagtgactggaaacaagataaggaaagcttaaacagtgataagagagacaaggctggggcaggctcagctcaagtgtggaggaggagcttgccttaggtatctatccataacaaccatggaatgggagttggaaggcagcttcagatagggatggggggcgtgggtgtgtagggatcatgctttggattaggtcctgtttctccataatcgttaactccaactatacttgcagttacagactctccctggttctctgcaacttcaaataaaagaaaaataatggtgagtatttgataaaatcagaattatcaatccatatctgaattatacctgagagagaaatagaattgtgagcagcagcagcacacactatgatgaagaaggcaaacatgagacaaaggcagaggcgccacagttgggatttcatgtctttctttctttcttttgagtcggtagtctctatgattggaattgggatgagatcgagatgtaatactgttactaataccataatattaacagtaatatccatatccatatagctcctccaaaacccgtaagcagtgtaaaataggaaagtaaaattattattagtaagaattaccaaaagtcatcagaggaaaataatttgaacaatctagttcaaaatagaaatattatatgcacacatttatcacagagaatagggctaaatgagaggaggcccagcccattatccatacgggttcttccctatgcacctcactgtctctcagataattgttgttcctttcctccgcacataaaaccgacgccgtttgctttcttcctgggaattttaatctagatcccttttaccccataacaatcaaactcaggcatgtctgtttctcttttatatatatcttaattgaattgaattatgtgtgtgtgatggaatttttatttaataaccatgtttatgcataaatttgaatgcagcgaaatgcagcagcagaagtacggtttgcagctgagggtaaaaccacagcagcaggcgaaaaagccaccacttcctaccaaaccccttttgtttggccaggatgaggatgatgataatgttgaaaaggagatttcacgccacgcttccaagaataagtctctcaaggatgtaagttaactatcaacttctctctttttacttaattgctctttccttttgtgttttatttgttttgtttcttttttccttataagattgaggagatgcataagaaagcattagaagaggacccttcggcatttgattatgatggagtttatgacgacatgaagcagaaagttgctcaaccacgccaccaagatcgccaagaacgtaaggtgctttccttctacattacactcgcacgtttcctctattatatgcttcctttcactactatacctatgtatttcacacaataaaacaatcattggaattggtgctttcctgctgattaaaatctttgggaacttttacatccaaatggtttgccaattatttatcgtacgtactaccccgaatttctgctccagaaatgaaattgatcttttcatacaagtaaacctctggtaataataccacttaattatgtgtgaacttttgctagaaactttctgttgccttaaaggcttgtagttttttatccttaactttatggtttatggaagctcaaatatattggggtgtgtgtcttgtatcaaatcacaaggaaacaagaaattgtgatgctgtgttatggcctggaaaaatttatagaattcgtattcattattcaatccttaggcttgtttaaacaagttttagttttctgtttatgtgcttatgccacttttttactagcacacgtttactgttacatctaagatgtgtttcttattcctttcctttcatttttatttaatggaagaagatagattgaagctcttccatattgatatatgaatgatggcaactcaaacagttttattggtttcctgttgcagcctaaatatattgaagcattgatgaagaaagcagaaatacggcagcgagaacatgagattatatatgagaaaaaactcactaaagaaagaaccaaggatgatcacctctatgcagacaaggataaatttgtcacgagtgcttataaaaagaaacttgccgagcaggcgaaatggatggaagaagagcgtctgcgacaacttaaagaggagaaggacgatgtatgtatatcttatcttcgtatttcttctactctttcttaacttctcccgaaatttgtctaagggttaggatatgcagggttaaagccctataccctatattagaaggcatgcacttaaccaggggtctagtttcccagtggctctattgatgcatcactatttgtaggggcatgtgtatctatttgtctacatatacattttatttatgctagtccttgttatactttaatctactttcgcatgctactatactgcaagtgcaagcagccatcagaattttcttgttgcatgatctgacatgatctcatatttttatattttgtatgggtagtcatttctcttctcatgctgagttgagtattaagtactcggacatataaccaatacactttgagatatcatcaatattgcattcatatgatcagcactttaatggtttgaaataattttttttctcttccaccataatattaggtaaactctatataacgaagttatttttgggatttccaatgcaacttttttatttcagaatgtgtttgtgattatcttcaagcatactttctttttttggtaaatattctacctggtcaattcttggttagatgatcaaggtgcatcaagtgctattgctgtaacatctctttcaataattcaccgatttttaattcttgaagttgtttttttttttttcattgtttctgtatgtatctattttgaaagctgttagatttcttctatttttttgtgacataaacacaagattatcacatttctgaacttgtttatcattcaagacttgaaccaaatgctcagctctatctagttgatcactagttgtcccaagaaatccatttgtaaactgttttgttctgatatatatttgatatttttcccagttaagctaccatctgattttctaatcgacatattttgtattggacttggatttctccagtgtttgtgagtggatgtgcacgcatgagctctccttaatgattttttgacccttgatagcaatccagttaagccacctctgtcctgcatatggataaagtatggtaccgcttatttgtttcattgtgcaaagtgctgttgttagttggctagacaaagtcaaccttctggttacggcactagtggtgtctgggaatggtgtaggtttgagaatggattaaattgtcagtttagagttcttccatgatcccaccagattcatgaacttgacccaaaccttgtttgcaggagcccctgaagtagttttgtaattaacatttttgtgtatcacaatttagttatttcagttggttaatgaaatattggggttttgtggtttaactgattccaatacaattttattttcttaagtttctaaaggagagcagcatttttttgtcactttacgacaactttaaccaggatagccttgtttgaatttagttggccagcatatcatttcttggattttctcttcattacctcacattgtggcttttattatgtaattagaattcggtgtgatatgagcaaatgaaagtttcataggcattgttttgaacttgttcgataaaacaatatgttttatttgctgataaaaaaaatgttgtgctggtcctggcctattaagatgatatttgtctctgttgttttttcaaaggttaccaagaaaagtgatttgagtgacttctacttcaatcttgggaaaaatgttgcatttggtgcaaaagaaatagattcaaggaagcaagagaaacaaactgaactaaggaagtcagagaagttggatgacgaagctgcaggtagtacatcaggcagaggtcgtccattgccagactcaaagtcaattatggagtcttccagggtgaacgaagaacatcatgatggaacttctcctgtccccattcttcctaggagaaattctgagtcctcggatgttaatccagtttcggagagaaaggttgacacttcagtacaagaaaacactgcaactgaagaaccattggccaatcaaccaaagcaagatcaccataaaagaaatgaagatacagtagctgcagctaaggaacgctttttagcaaggaagaaggcaaagcagcagctgtgactgctctggccctctggcatgtaatatctgtagtgtgctcatcgcacttctgctttctgtatttttggttccatgctctgaaagggggttaaagctagatgtgcactgcaatgtgacagtctgttatttgtaatttaattttatgagaaatttgaatttgaagttgttggtacttgaaagatgtgtttttttttttggtaggctgtccgacatgcattttataaaagaagatttattcataataattattaaaaaaatgaaggaaatgtaaacttgaatgtttgaagaattggcgagatgcacttattggaatgcaatttgatggatacacattagcattggtggatacaagatgaagtgcatttagtagacatgcaagtgcagtttgaggtggtatcctcagttggattggcagaacataaatgagattggctctgagtaccatattggagtacagaaagacccatttggagacttacagcagcagggataatgagaaaacattggcattgctaattcgcatatgctgctgcaacacagaaggaagaggtcaactatgttgggagcagctaagcaaagaaggccgttgtataatttgttcatcataatagcttagacattacttacaactgagactcagacagaaagaaaagccagcagcagcagcattcacatgctacccaacccaagagccatgtgcgtcttaccttaaagacttaacaaccagacaacaaagggttatggtctgtaggtcccgtatacgacagacaatccacagtaagaggaccgcagtttcatgtgcaaacaatgacaagtgccaaccatctgctttattattaaatgcttgcaattggaaagtgcaatccatcagacgcttttttgttcagcaacactagcgcacctttagattgattgaatagatggctgatctttttggtggtcagagccatgcacagtgacaacagctatactattactggaaaatgattgtgtgctagttttgtaatgatagaatatatataataaaattagaataagtaatctatgtacaaactagtcattatttatgcagttagctaaatagcaaacacatgcctcgccaaaagttatatctcgaacctaacctatcatcagaaactaaataaggattactttttgcagtgtaggcaaaagcaaacaccatggtttctgttccttgttctttgctactttctattgctcttctctccgctatatctcccttgtcctcttctttcattagcattccattatcacattcctacacaaaccaaaacccctctcaagatcacttgcaaaagctaaactacctagtctccacctccctagcgcgagcccaccatctgaaaaatccccaaacaactccggtcttttcacatagctatggaggctactccatttctctcagctttggcactccacctcaaactctctcttttgtcatggacactggcagcagctttgtctggtttccatgcaccctccgctacctctgcaacaactgttcctttacttcaagaatctcaccttttcttccaaaacattcttcctcgagcaagattattggctgcaagaatcccaaatgctcttggattcatcaaactgatctacggtgtacagactgtgataacaattcaagaaactgctcccagatctgcccaccttatcttatcctctacggttcagggaccactggaggcgttgcactctcagagactctccatctccatggcctaatagtgccaaactttcttgttggatgttctgttttctcttcccgccaacctgcaggaatagccggttttggccgtggcccttcttctttaccttcccaactcggcctcactaagttctcttactgcttactttctcataaattcgatgatactcaagaaagcagctctctggttcttgattctcagtctgattccgacaagaaaactgctgcattaatgtatacacctttggttaagaaccccaaagttcaagacaagccggcattttcagtttattactacgtaagtctccgtcgaatcagcatcggtggccgcagcgtgaagatcccctacaagtatctctcaccggataaagatggcaatggtgggacaatcattgactcggggactaccttcacttacatgtcaactgaggcctttgagatactaagcaacgagttcatttctcaagtgaagaattatgagagagctctgatggtcgaggcattgagtgggttgaaaccttgctttaatgtttctggggctaaagaattggagctaccacaattgaggcttcatttcaagggtggggctgatgtggaattgcctttggagaattattttgcttttcttggtagcagggaggtggcttgcttcactgtggtgacagatggggcggagaaggcaagtggaccagggatgatactggggaattttcagatgcagaatttctatgtggagtatgatttgcagaatgagaggttaggcttcaagaaagagtcttgcaagtgattggatttggaatgctcaataaaaattggtaaaaggtatctcttttgctagtctgttttggcagctttcagtttgccaatattttccccccttaatttgatacctctgataatcattggtttcgtgcaagtacccataactcgattatggtgtagtgaaaatgtaaaagttaactgaaagattctttcttttttttgttgattcctgtgttaattatatattactacaagaaagtaaatagtaaacttgcttaaattttagagcatggcagatgtgagaagcaaaatggggagacacgagctccgagttcaaacttcaaaaaagggaacatgaaattaacaaatagaagtattatcgatatctgatgaagggagctttgtcttgttctctcgaggaccatcttgtttcagaattcttaaattaatggttttctctggcaattccaggcgctggcctagagtcgctgctcatcatcgagctcagtttccctcttccatctacttcaatccaagaatcagcattgaattgcaaactctgtcggcaagcattgtttgtttgcttttgatacggcatgccatttctggatcgccagaaactgttgtttgctgacactgattttccatgtgggctaatgctctggctgccttctgataatttcaggccatcctccatgcctttagctaactcaacaaacattgtcctgttgaagttttgatgacccctacctgaaccaccaacaacagatgatgaggcaaaaggttcaactctctgtatcttctctatatgttctcttaaatcaacagttgtaattcctcttcctcttccccttcctctacaagcaccccatccagtgtttgcaggcccagcacctttatgtatctgctcagaagatgagctcaactcagatttcctgcagtagttactgagttggtaataatttaaactaccaacccctctctctcttcctcttcctcttcctctaccacccttgtgtgtaggctcaaaataccagtttgaagcagattccccactgtagttgccattattcctctcagcagaaaaacttggagcaaaatcccttctatggtacgactttatgtggctttcctgaacccgcaatctgtatatccaatattgtcattcagtctagcaaccagtgcacctgaacactgaatgaaagcaaaactaacctggtagggcatctgcttccagggcattcatgccaaagctgggtctccataatatcatcatcgccaataatctatattgatattatgatattttaattctttgtggtaaattaatttcaagaaataataccatcaaggagagtgctaatagttacatgccaaatacctgctcaggatactttacaccctccagaggacggggaataaactgacttccctttggcaactcaaatagaaggcatctgcaatattgtacggcataatacaaaatataagaatgcagagacaagatagcctaacaaaatatgaataatgatgtcaagttggcctacaaaacgtttcttttttggatgtcattccatagctgctcaattgttaaatcaacctcataagcgtcctttatgcacaagcataaagatcccccaattccactgcaaagaagttacaaagaaaacatacagatcaatcaactaggcaagagtacttatcaatgtttgaaaagcttataccaagataacacctccagttgcaatgaacttacgaatcacaagaaccgattttagtgttttgctgctatttcctggactcaataatatctccattaataagaataatacagaaggccaaacttgtagattcaactccaatggagttcatcaaataaaaggcaaaagattgttgagcgttgggcaaatttgagggaacaaatttcctataattaacagaaattaataatgcttcccaattaatttgtgaaaagcatttatagtggtcttggaaggccatagctcaggcatgctattggaattacagtttcatatttgaatataatgtgtggatctcaagttttcctcatcaacaatactccaaatctggtctgacatgtgacatccactgcagatgaacagggtctactgtgtgctagacagaaaatagaccaaccttaaactattttttatctcaaccatgtcttttggcctcccagctgcaaactctgaaacaagttgcaacagttgtgattccgaaaagttttctcttctcacaaaaagcttatcaacattttccacatttttatctgcttccttcctctgcatgataataaactctggttaattatgaccaatatacctccagtgtgcttcaaacatactgtcaagattagggaaagtgcatcaattggctaaaaaaagtgcaggaagaaaagaaacagcttaccgttagttccttctccatctttttggtctcagctaatagccgttcttcatctataaaaggaagcttgcatattcccttttataagccaatcaacatattggtaagtattaataaattttcataataaacttgcctagtgggagacaaacattcaacaagctatcataaaagttactgaatacaaatcagtagcaaacctgccacataaatcgttttccgtctatatcaatttgaaactctgcccagcaagggaattaaaataaattagtctctttgtaaggcggcaaaataagaaatgatccacgtgaagcagcctcaccagcaggatagaagtctataatactggaacgctcatcaatcatcagttggcggtatgatttaggaagtgcatgagcactgcaacacagcaaagttacttgatttaatcatgcagaagaagaccaaatcaatattcatttaggcaaagaaatagaatggcaggtttacctccttggaggtaatacacccatcagctggtcaaagggtttaaatggtgaaccctttggaaacttaaacttaacctgggccatgcccttcatatcagacgcaaatggtgcatgatgatatggataaaacctgaaataaagttagtgtcaacttttcatcactaactggcatggcattattctgtggtattaacaaaggccatccaataaaaattcataccatgtccatgatgggactgctgaaaaataatatccaagcacccataatagtccctcagtgtacttttgcaccttttagttcaagcaagagcccagtttagacaatatattttggtcgggtctaccagagtccagaataaccttaaagaatacaagtatgcagcttatttgaggtaggagatgaacttcaaaccagaagttaccagtcataccatttctttccgaattaactcaatatcgctgggattttctgcagaaaatttctgttcatagtatctttttttccaacctgtagtccccaatttcaccttcaaagcaaacaagccatagagttctgttggattttatgggaaatagtagaaaattaactgaagataatttaagatacatgatcatactgtatctgccctgaaaccgccattttggaaaagatcagatttctgcctaaggcgagcttttagttcctctttgaacctctttgtattttgcagtacctgtatcgcattatcaagtgataattatgaaagaatcaaactgaaaaccatagacttattgacactgctgagacagataccaagtcttcagaaatctgggcctttgcatccagagaagaaaatgagatcttcaacatatcttgctccacattcccatctaattcttttgcatcttcttccggctggagaaccattaattaattccacaagtgtagcgctatgaaagtcttatggaaaggttcataatggaaaatatttaaagttcaaagtgtaggcacttgctgcatctgaatgttggcaaagctttctaagcatccgctcacgtagttctgatcttttcttgaagatcatctcttcataagcaccaatcaaaagaataaacttttcaactctttttagatctaaataatcatttttcaggctgttcacctgttaaggttagatggcgtcattacaaggtgaagatacagataattcaagtacttgtaatgctggtaagaacttcttatttattatattacctgatgcacatcaactaggtaaccgcccagtttcttgaaatttttcttgtaaactgtcatcaacaaatcaacagctcgctgcacagaaaaaaccaaattaaaaagataaaacttatgcacaaattatagtttttcaaaagaaaaaagtttaaatacaaaacctgacagtttgtatttatattaatcaacaaaacaatacctcgtggatttgcaaagtcggcaaatttggtataaaatcatttccagcgaaaaagcacataaaaacaaaatcatcaatgatacgttcagaatcaaaagtgaaattttcaggaggatcatagatatccatttcaagcttcaaatagtccctcaatatccacacatggagaaactgcaaatagaacaaaatcttatagtagattaactgagaacttgttgaactgatttgaggtttaagaaaattttagtacctgataaggcttttcaatgaaagatacatctttagcaagtgtgttatcatcattagagaatcttctttttgttttattttcactagagccaaactcaccaaactcgattcttccctgtaggctagtgtgtgctgataaacagattgattgaggctgttgtaaaagcacgacctgtaaaaggagaagcctaatgaccacaagatgaattttagaatcatcatgcacagataccctaaaggtttctgttctttaagttgctgattatatcaagaagcagttgcgtacgaaaacccatatctatcaaatagaagtcattttggccagcacttacatgcaagattgataccagatattggttatgagctcagattcacatgaaactgccacaagttatactcaaaaataaataaacttaaaaaggcattgtatggagtggtcaaagtatcacctctctcagaatggaaaagtgaacttcgtgcgatgccaaagcaagcattattaaatccgcatcctacttgccaagattgtgcagaaaaactaacagttagcactaggcataatggtgacttcaaaatgggaagaggatggcagtgaaggatcaaaattgaaaatgcaaacatgtttttactctcaggcagaagaacaggggtttgcataccagaccatagaggcaatggcgtgtgttaggattataatcaggcagcatgcgctgctggcgtataaaagacattatcttatgttccccctcgccaggaacactggcatctgaaagaattacctgagaaaatgaacagtttaaattggaacaatgcatttttggtgtacataagacacaacagtgctccctcagctaggggcattgacctctgaaagagttagcaaacataaacaattatgtgaatggatatttggtattgcattgaaagaagaagaatatgatatgttcatgaaacttctcataaggtatgaataaatcatataagcgtattggtccatcgaaccttaatagctttccaggcaggatcagagtttatattggaaatcatgtactcctggagttttattgacaatgtgaacatgaattctgtcccaggtgttattatgttggaatctgagacttcagagtactgctttgggagcacttgtttaccttgaatttcatattcctttctcaatcgttcctcctcagcctcctgtatcaaaatttaataaccaagtaggtttaaccatctttttacagaaatgaatatatccataaacagaaacgatactgacagcaatttcagtgtctttagcatttcgaaaacgtcttgatctttgctgattcatttttgcacgtggagctactccatctgcatcaaaatcaaagttaaacaattgtaaatgtaaaagtaaaagatgcacggctatctctggccaggtattaatgtttgtgctaagaaatacatagaaaagagaataaaaatgcctcatccactgaacactgtgttcaggaaggagcaaaagaatagcggtatgttgagttgaagaaattgataattaaaaagaatctttgaatgaaatgaactcaccaatagctaggtatagtaaattccttggtctcacaatactgaaaatatgatcaatatatttgtagatgttgttgaagacttcatcgaaggtggttggtggggaaggctacgttacaaatttctttctcagaaaataataataattagaaagaaagaagcatacagagagaggcaaggaagaagatacggaaaacaaaaagaaaacaacaaaataatcggaaaaagaatacaagcttggaaaagaagatagatataaagagataatatttagaaagaacaaacatgatcatcaggatggaagcatggatgaatgatgccattcatgtcaagatagagattatcaaactcaagtccatttgggtttggagaggtgatgacatttggatatttgttgacgagccacttataaaacgcaggtacacccatctccttctctctctctctcttgctacagtgtgaataatgcaattgcagaaaatggttagctaaacggagtgttatttagattatgtactagagtagtagaaggtcagtagagaccaaacaaatatacttgcgtatggttgaagcgaatctatggggggttcttctaaatttgacggctacgccatcatcaccattttcctttccaacgtaacgtaaatattcttctgaatgcagagatgctctccatctcagtttaactgttcaagacaagtaactatcttaaaactagtatcaaatgacacttaattgctgtggcagtgcctaaacttttattttattttattttattttgatatctaaactttttaattagaatatctcccaacatgaattcgagtgacttattatttaatatttaactcatttaaaatatgtgtttcactaattttagtcattcttttattcagaattttatttctagtttttaactatagaaattatatatcttcaagaaaaaaaaactctatttacataaaaaatatcatttttaaaactagagttagtaaaaatttattagaattagtaaaatttgtaatttaaaatgaattgaatattaaatagatattttatagttttttcattgttatataagtaataaattatttagattttacatttaatgatatttcagtgaaatgatataaaagtaaaattcaatactacaaatgaaataaaagaaaagtttcatcacttcaaataaattgaaaatcctgtaaagttgctcgtttataaagtagagaaaagaaaaggagatgctccctcccaattgcaataacaaaaagaggattggccattcattatagtggacttgttctcaagaaaaaaggaaaaagaaagggcaaagcattttacaatttgaaagaattattacttttcattgtttaatttaaggttacaataatgacttcataatattcaagttaaaattaaatatcaaccgtcaaaattattcattacactatgattcaccatttatttcttatatcacgatctcacaacaacaagggagatattaaaggacgcaattcaatctgcttctccaaagacatgctgaagaagaaccttccactccttgtgcttcagaagtatgatctcctgaacaattacattactagtcgaacaaacatttttccgtccctttgatcattcagaacattatttgattcctattaaacatttatatgactgcctatttatcatgtgacctctgtccttttgtgcttcagaagtctcatctcttcttttttctcttaacccgtctttcatttggctgcatataaaaatgtgttggaaaaggaagaaagtcaaaagcaaaagctcaggtctcaagcttgtgcagacctatcatcacagacctcaaagtaaaatgagcaacctttcctgcaaagcaggaaaggtcacttcaacccatacccttagtagaaaaagtcgttaggcaatcgttagaatagatttctcaatcaaacaaatcatatatatatactaatcatcttcttgtaaagaactcataattcatatatgcaaaatatacattcttcactgttatatttttcatatggtatcagagcaggtttaacctatgctcattacttacctaaaaatcctttctcactcagctatgtctcaaaatgacaaattaatcaacatcacactcaaggaaaattcaaattacttcgaatggtcaaaaacagtatttattgcccccagtggcaggaaaaaactgggatacatcacaagaacaaagcaaaagccgaagcctcaaagatcagaagcactcacagaagaagaaattaaaaaattagaggagtggcagacgactgaccatttggtcatgtcaatgctcacaaacactatggaacctcaaatttctcatctctgcatcttaatggaatcatcaaaattaatttggaaaaaaatgcagagtctttatggtcatcaacacaattttgctcacatattcagactaaaacaagaattatcccaaatcaatcagggaacaaaaagttcatctcaatacgcaacagagatacttacaaggtgggaagagttgcaaaattatcttccgccttcaaacgaccaaaatgaaatacaaaaaagatcagaacaggatcttgtgtacacttaccttggaggtctggactcaagctatgaaagcttgagatcacagatcctcctcgcaactgaccttccaaaaatcgaggaagtaattgctagtgttcaacgcgaagaaacatggagaaacaccatgaactctccttcgaatctcaatgacaaccacgcctacatctcccgaagaaacatgtcccgacagcaaggaggaccaggcatcatcgctcgctgtgaccactgccaaaggcagggtcactcccgcgatggatgctggttcctctacccgcacataagaccgtcttgggggggaggggaaggcgtcggcgctagcaacatgaggcgagagggaagagaagaaaagagaggcagtcgaagcttatatgtcaaaaaatgaggggttagggttaaggaaaagagaaatttataatgggtctgaatggctctcgacccgacccgacatccaacccgaattgatgacctggcgacatgttgacccgacctagatggagactggcccaactggattccaagcccactccactgggtccagcccaactcgtccttagcccacttagttgggacaacagataggccaacatgcccatccgacttcatcagcccgacaggaccagtagcacagtcaggcccacataacagaaattctggcccagcttcaggccttagttcagtaaccccatgggttcgggtcttcccagcctgatgggataggttcggttcaaaccactttaaattcagttcaaaaaaatattaattcttgtcatcaagcctggatcattgactctggagaaacaaatcatatgacttggaatcccacaaaattacacaaaattaattctataagggatccccagcatgtgacagttgccaatggaaacaaagtcaaaattcaaggatatggcaccactaatctatttaattctaatcttacaaatatatttttttgcctgattttaaatctaaccttttatctattggcaaaataactcatgatttaaattgtaacgttattttctcaccatcttcagttatattttaggatcgagtttccgggaagacgattggtgaaggacacctagaaaatagcctttattatcttcatagtcctcccaagaaatgttttgtttcaaccaattccacccaaggcatgctaatgcatcaaagatttgggcatccttccgacaatgttttaaataaattattttgttacaatttgaactctagtaattgtgatgtgtgtaaattttctaaacactctcgattacctttttcattatcatttagcatgtctaaaaatctttttcatctaatacattcagatgtttagggacctgcgtctgttactgcatacaatcattttagatactttgttacttttatcgatgattactctcgcaccacctggatctatttattaaaaggaaaaaatgaagttttttcacgcttctaagaattttttaatttcatcagaactcagtataatgcaacattaaaaatctttcgctccgacaatggtacggaatacataaattaaaatttctctatattttttaaataacatggaattttgcattaaaccacatgtgttaatacttccaaacaaaataatgtttctgaatgtaaaaatagacatcttctcaatgtcgctcgcactcttcttttccaaaataatgttccctctgttttttggtcggatgccctcttaaccgctgcctatctcatcaatcgtttaccctctatcattttaaaaaatatgagccccctagagatcctcaaaggtcgaaaaatagaaattggccaccttagggtatttggttgtacctgctatgtgcatgtcaaacgccaacataaactcgataaaagttctatcaaaactctcttcctaggatattcttccactcaaaaagggtacaaatgttatgatcccttgactcacaaaacctatgtttctcgtgacgtcacttttgtcgagactcatccctacttcactagtcctaccagtgttgacttcactcacgaaccctgtcagttgttatttccacttaactctgatttacctcttagcagctctgatcaggatcatcagtttcagggggagtcaccccctgtctcaaggccgcttccttcagggggagaaactcaacctcaagaagaagaagaaattgccttaagaagatccactcgccaatctagaccacctgcaaaatttagagactatgtgtctcatacggtaacatacccaattcagaagttcatctcttataatgtcttatctaaccaatatcacaactatctttgccagatctcaaatcacattgaacccacaaatttctatgaagccaacaccgaccctcaatggtgtaaggctatggaagaagaacttttttccctaaaaaaaatgatacatggagtattgttcctcttcctcaaaataaaaacccgtgggacgcaaatggatatacaagatcaaatacaatagtgatggaaacattgagagatacaaggccagacttgtagcccggggcttcactcaaacctatggagttgactatcaagagacatttgctcgagtggccaaaatgaataccgtcagaatccttctcttaatagcaatcaatcatggctggaatttattccaaatagatgtcaagaacgccttcctacaaggcaatttagacgaggaagtttatatgagtcttcctcctgaacacaagtcaacctcaaacacttcccgggtatgtaagctaaagaaggctatctatggcttaaaacaatccccgagagcatggtatgccaaactcagccgttttttattaagcattaatttcagtaagtgtgaatctaattcatctatgttcgtgaaaaacactcacaatcacactattgttattttagtgtatgttgatgatatcataataatagagaataataatcaagggatagagaatgtcaaacaaagtctaaaaagagagttcgacatcaaaaatcttggttagctgtcatacttcttaggcatagaaatggcaaaatccagcaaaggcttattcatatctcaaaggaaatatacccttgatcttttgaaaaaaaactagaaaaataggtgctaaacctgccatcactcccatggaaaccaaaattaaacttaacttagaagatggagaacccttaacaaacatagggcattatcatcacttagaaggaaaactgatttatcttactcgcactaggcctgacatttcatttgcagttagtatggtgagccagttcatgcatgctcctcgcaccagtcacctagaagctatagaccggattcttagatatctcaaaggaactcccggacaaggaatctagatgaagaagaacaatacttcaaatatagttggtttttctgatgcagattgggctggaagctgtgacaggaagtctacaacaggttactgtgtctttgtaggaggcaacttggtgacttgaaaaagtaaaaaaaaagtgtagtggccagatcaagcgctgaagctgaatatcgtgcaatggcatccactgcaagcgaacttatttagatcaaacaagtcctcagagatatgaaaattgaaagtaaagaaccaatgcaaatgcattgcgataaccaagctgctcgacacatagcatcgaacccggtatttcacgaacataccaaacacattgaagttgattgtcactttatcagggaaaaagttcaaaagggagaaattgagactccttatgtcagaagtcaagatcaactggcaaatatattcacaaaggccctggacagacagaatcaccattcaatcctcagcaagatgggttcaataaacttattcgaactcaccttgagggggtgttagaaaatgaagaaagtcagaagcaaaagctgaggtctcagactaggttgcttgtgcagacctatcattacatacctcagggtaaaatgagcgacctttcctgcaaaacttcaacccatacccttagcagaaagagtcgttaggcaaccgttagaatagatttctcaatcaaacaaatcatgtatatatactaatcatcttcttgtaaagaattcagaattcatatatgcaaaatacacattcttcagtgttctatttttcataagatgaaaaaagaaagaacaattcttgatcaatgggagttttctaagtcattttcgttttaactttcagtggtcctctaattactatccttttcattactttcttgattatctatacatgtggtcattgtcgtttatactatgccaataacgtttactgtgctatcaaagaaagtgacctctgtcctctatctataatacttttaccaaataaaaatgatggattcaattactcaagttaaattgtttaaacattatcatcttctttgtacttagttgcctgttgtatttccagacatttccaagttaaggtgatgcagataatgtgaaaataataagaaatcctattagtgatagtgggttaaggctaccccacatcacacattagcgaattggcaagtaaagtacgcaaaatataatcatcccagttttagaaatttagttcaacttttataaaagtagaaggaaaggtccattatgatttctctttattcaagcctaactaatataatgtcgcatcttaacaaaatgcttcatgacttcatccatgtagttcgcaacctgcatttcacctaacctccaaaagcttcacagtatatggcaattacctgaatctggaattggttcatcaaatacatcttccgatgacatgtctgttgagagaattggaaagcaaggctgattaattgaagggtcaagcagaaccaagaacagcaaatttaaaatgccttggttaaacaattagggactgtgggaacttagcctaaccttgtaatactataccgcatctacttctagaacctagaaaatgcaaactctgttctgtttccatagaacaggatcctaagaatatgctggtatgtcctctataaattaaatgcaactttgataaaagtgcttagagataaataaatatagaagaaagaattgttttctcttccaggattaacacttcggccagaaattaaatgcgcttggtaatttgacaaaagatctcatagttggaagacccttgcaaccttgcaactcacagagttaagattgtaactttatggctgattttcaaggggcactcttatcatctaattaatcaaatagataaaaggaatccatcaacgaatttgtccaaaaccagtaactcggctcaacccttttctttctctctttcctgttaaaagtccctttcctttctttatccttttctgctcatggataagcaatcaaagcttactatcaagaattgaccaacgaagtcattaaggaaaaagaaatgcagagtaacatgtaagtaatagctgtgatttgaaattgataatccaaaattggacttgtaaatgaagctaataggaaaagaagaaaaaagaaaaacactaattatctagctaggagcaacttccacagagcaaccttggacaaattgatacttgatccctaccccatcagcaatgccatgattacggttgccgaaagtcatataagcaggacaattgacattgatacgatacctgcctgaaatccaggagccaaccttccatttgagatagccgtcaaccttaatattgacgaggacagcaccagcatcgaggtcttcgttcaaagcagaagctagatatggagacatgggaacagaattaccataaagaaatggagaccaaatagtgatgtctttgtgaccctggtagctcctaggcagctgtgttccgagggtcatttgctggttgcggtaggacgcatatatatcaagcttctcatagtatatcccaatcctctcattggggtttttggtggatagagttacctgaatgttggaagtaaggaagtttgttcctgaaaaagttaaagcattgacggtagcatcctgaaggatgaatctaggcttatgaggctggagaatgagccatataaagaatatcactacgaggacgatgacagcgagagtgatgatcccccagaataagcggcggtggagctcgtgcttctggccgtggtggtcgcacttcttctcgcacatggttcctaatgattaagatgaatatctgaagaggaatgagtataaggctcaaggtgaagagcagttgcaaatgacaagcaggggtgacgatgaagagagcagtcgttatttataaagagaaatgtgaaagtgataacatatatatgtgtgtctgtataatgtataaataaataagcgaaatgtaagtagaacggggaagtggtacacatgcaaattgggtggtgggaaattgaggcatacgggtttagttttgggggtaaaaccttatccctgtatttttggccgcattaaatgacaagaatacaggcacaggatggccataacatatgtttccttttctttaactattttacgataatatatgcatgcatacagtttcacttcaactggaattgctttatttgtttttcacttttatttttttatggtgtctaacaaacttacttttaatttactactaagccacatataggcaaattaatcaaatattgttactataacttttactgtgtccaagtatgataaacaatgatgttggagctggtgagatttcaactggatatgcaattgtgaacattaattcaaatttaggtaatgttgaaaacagtagggaagagtgaaatgaacatataagcaaattctacttctattcaagttgtaagtcaattttctattttcaccagctaagaacatgtgtttctacctttgttctaaagtaacttgatttttatttctatgttaaagtaaaaaatgttcaatcgatctaataattatctaaagaatgatattattaaagaagcaccgggttatgttgtatccacacagagcctccaataatggttgttaaattatttaattaattaattatataaaagcatctctaaaagaaaataaatctattgagaaattataatgcattttctaatcaggttaggaaacagttcaaagatgaacaaatagaagaaaacagtcatatgtgttgttggttggaagatgatcgatgtaatataacctcgcaaggactgtctatataatatacaagaagaacaaactcagaattaggaggggcataattaaggatgaatttgcaggtgagggaagtcatatctgtaattcagttacaggtatatttagggaagcagaccgacaaatttcaaaagagaaatgatatgattagaggatgggaagtcatatccgagctgttgaagttcagaagattaagttaccatcgtaactttatggctaagaatatgaagatgaaggacgaagatgtatatatataaaccaacccaccacaccagatcataaaactgaagctagctaaaggtcaagggggtgataataactaggaacattccatctgtccttctcaaccataaccgtgtgccaccgacattaattagtacgcaggctgctgctgctgctgctggggttttggtctgtacagtgcatgggcatgtgaaccgttcaactacacttaattaattggagttggcgagagagaagaaaatgttgcaagtgagttgagtctggaaatgcttgcatatataatcttctgcgaaatggaaacgaatataatggatttcataagtgggtgcatgcggcacattttcttttttatgttaatgttgatgttaattatgacataaaaatagacatgtcttatcatcactctgctataaccaactccacaaactaaacttttttatttttctcaacgattggatcatgcatggtggttgcgagtgctaattaatcacaagtaattaaataaaaccaaaaatctcaagttaatttgcctttgcttctaagggagatatgtagtattttttgcaggacgtttctaaatttcttgtctttaagttcaaacaattcttacttactttttatttctcaccttcttttagtacacttttgatccctgagcttgccctaactttgtttccattctaattcctaagcatacatatcactcaaattcaatatatctttttttttttatttggtacgcttttcattatcatgtatataggggctttctgaagctacccaagttaagaatattcctttggaacatgtctctgtccatggagaacgccagtttcataaagatggaagttgagcatgcatgccttttcatccaaactcccttttctttttaatatcaactttatactattagctttacactccttttccttttgcctttctggtgccctatttatttatatgtaattggattacacgataagacatccagactccaccaccatgcctagttttttattttttttattattatttatagttaatggattgatgatttgatatgcatagttttattgcggttccctttccaagtaatcctaataaatttggtgtcccaggaaaagcaaacaaaacaaaacaaaaaaaagtagtttaaaattgtaaatcgggctatccttccatatatctcatacaaaatccatacaattttgaactactacataattcttaggatctaatgcttaaaacatcaccaactgatagttaggcattgggctctctcgtttaaacatgcccaaaggcatcaggaagctgcctggcgttctcttagacacatataaagtgggccgaatgaaggcagactatagaagctttaggcaaaaaaattggattgggctggtttccccgctagcaacaccggaatacattacaaaccggaatcctatctatggtgttctcccttagctcctattctaaggcctatctatcaagacttgtgttgcggtatagatgaacaaataacagttctaatgatgattctgcagtccagcatcagcatacatttaatgattacagaaatttgagaaaaacatctaattctttacatcaagcaatcgccagttaaaacaatgattgactgagaagagcaattccattaaccaacatgcatagaaatctaaatggaccagcacaagccaatattcgacaaccaaatcatcacattccaagcacagacagacacagccaaattggtcctcatatgccaataggaaagtgaaagagaaacgcccctttctctcttcattttccttcattgtctttccaatcgaaaagtggggtgcaatagtaccttccctcatgcaaaatttatagcaactctacccatactactttaccctctcagcataactggcttttctagttggtagatgggttggtgaacggaataaggaagaaaacaatgaaaggaagcagcaagccacaaacgcaaggatattcttttcccctaacgaaatacttgaactgaatcacaaccttccttgtggaggaaaacaaagacaggcacaggcacagactggcaggcagcatgtgagattgaaaattaactttacccatgaatgaaaagatagtaaagacctcattacaagacaacaatggctttgatactgaaatgaaaacttgcaaccgaagaagtattaagagtatgtggccagaaggaaatttttttaatgtaatcgaatgaagtgagtgtcaactaaggtacgcagtgaaaaaactttcatttcactggctgcaaaggaaagttcctctgtcagctgtaatggtttagagactaaacatgcgagaacaagaaattattttaggggtcgccttgtaacaagaaagaaagaaagtgaatttggaaactccaattcctggaaattggaaacagtggcattgcatcgatttgattcactcatctaggctttatcaaagagaaactattaaggattttagaactgcaagcatagaggcatcaggttctacccacctcattgtagagataaatataacccatcaagcgacttagatgcagtgggttccaatagagaaagaaatgaataatcttgtgcacaacaagagggagaagagaaggagtacaagtatattgattccaataatcctatttcccaacgggaagcaagccaaatgtactgaataaagatgaaattggcatagaaaagtagcataactcaattaaactgcagaaagaaatcaatgagcatttagcataaactaagatcactatacaaccattaaaaagagatgaaaaggaacagattaaaattttggatttaagaaaaaaaaaaaaaaaaagcctaaagccatgtacatctacacaccctgacaattactttcctcgaatgtgcagttataaaatgattactcactcaggcataaaccttgcattccctggaaccaccggtcaagttcccagaaccactagtggccgaagaaagggatagaggcacattgtcgcaccaaaccctaagcaaacgatgacgggctctaaagccgccaactttaaagccaacatcagccatcaacctgacattgaaggcgagggtgggacgtgcagcattaatatccttaaggacccggtcgtcgacgtaagtgtcgagagcagagaaagaggcatcaagagaagtgagattcttggtgtcctgatacaggggagggattcgggtctgagataagagctcagatttgagaagaagagagcagacgatattatcataagagatcttgagtttcttattagggttgtaaacctgaaagcgggcgttccagttggcagtgagcctctgggaggaagcggagatgttaaaattggagatagaaaaggaggtaatatgaaattgggggcggtgggggcggatgaccagccagcaaataaggaagatggtaaagaagagaacggtggcaacaatgatagcagcgatgatgcggcggaggagagtggtgcgataaaggggggttggggtttggtggttgtagtagtagaggttagtgggagggggggcataggggttgccgtttggaaagggatgttgggaagtgggggcggggtagccagtgacgggtcctgaataggggtggggttgagccatagtgattcacagtcgcaagagcagaagagaagatcgcagtcgcaccaattttggcataataatttaatttcttttccttcctacatttttttaattccttaatagaatctattagacgagagagagagagagacagagatagatcgcagctaatttaaactcattaattatttcctaataattattatatcacatcttaattcaactaacaaacaatttcttttccctcaaaagagacgcacaattcctttaatacattctctcaatctaaaatcaacggcagtatcgatcatcatattatattattactaatatcttaatcccttttttttatgatgcataccctttgtatatggtttcttttaatctcataataattatttttaagattatgtgttgttatgtttattttatttttaaaaatattatattatatttttttttactattaaatttgtttgtataactttttttaagtcggataggacaaaataaagaaaaaatgagtttgttttcttttcttaaaaaatatagatattccattaatgataattaataaatatatattgatataaaaaataaaaataattatcaaacatcaagaaatacaaataaagaaatccacttataacaatcatcaattttgttgatagagcaataaattacaattttggagaaaaaactcttcattcgttagcactaaatcacatgtttactttatagatgtcttttgaatattagatttgatattttttctttctttcacactcccatagagagaaagctcactattcatgtaatgaaagaccatacttttttttataaaaagtgaattcaaaatcctcacaataaagaaccataaaacttcttaaaaaatattaatatttatttattatgactaattaataataagaaaaaaaccattgttaatttaaaaataactgacaatgggtcaaaaaataaaattttgatgaaaaaataaaaaaaaaataagagaaaaagaagagtggcggctagagttttttggatttctttcattaatattaatattgcataggtttatgtattgagtaaataattcaagaagggttgtccggacattaattttctctctggtttatgtattaaaattgcaatctaaaacctaatattcatcttcattcactctcatccttcttactaactattgaaacaaactttaaaatgtttctttccaactcgcaatcaaagacctcatgttattatttatatcacatttaagtgttttagagatataggccttacaaaatttcatgagatttcttttcatgcaagctttactttaccgaaaaatacatgatttggatttctaaacagagtaaaaatagtgatttaatttataattagaccttttatattcatatttgtatatttctcattataagtagggttataaatttgaatttgtttaatgggttaatgtcggaccaaattttaatagttctcctacgcaaaactgttatgatgttggatagaattaccctacaaaaattaaatggaagagataaacataagcatttttgacgggggatctattctaaatccatactttgccttctgtcacaaattaaaggactttgcagctggggttttatgctaattgaatctaccgccgagcggacactgcaatgcgcatgtgaatcaaatcctatgcattgccaattatgatcatcatacaccaattacataatatggattcaatctctcgctaagcattccgatagcatgtcatgtgcaatttagtttctcaaagtatcgttttggtagctcagttttgagcagtgaggaagcacagcatattcccccactatgatttgctgctgatgaagtggtttttcggcttaacgaaatctatctctcgctctcaaatgaaagcagaaagcgcttaaagaatcagcttttgtgcatgtagacaaaagaagtataatttcatgtctgagattacaacatcagttcgaaagttgagctcaaagaacagatcaaattgttaatcatgtaaagtacccagtactgctatcatctatcattgcaaggaatttaatgacaacattgaaattatcactcgctcacaaagaaagaaagaaggaaaaaatctttaaaatgtacatgtaaaagcctttctcaaaaaagaattacgcgcaaaagcaaccaaaatttatcaacaaattaaagagacctagagctagagtgaaactattaaaatacctaaaaagataaccacaaaataaagataattccagaagaatgagttccagtttgtgaccaaagtcttccagcgcccattgacgtcgcaagtagtattgctggaatcaaaattgagagttgcgataatcaatggaaactggaccttgagatcctggcggcacacaaccttaaccgtgtcggtctttgcaggccatgtccacccttcatatgtggccctggcttgcatctccatcgtcagattaatagccccacaagacgagatattctgatcaggaccggtagtgctgctacagttagtaaactgtaagaacatgttagtgaaggctacttggatgttttcctggacgttacctgtctgaacaaagctgggaatcagagtagacgaagcatggctatagggtaacagtgaggtggcctcgattggatggtaggaaatggggttggtattagggttgtgaatggacaaaacaagattccaatgagcagttataggaatattaatattggaagaggcattgaggagagataaggaggaagagttggatgtgaaagtagggagggtaggctgaagaaggatgaggaacctaataacagcaggagtagcagagattagaaaggccaatgttatgataaagacaaaaccaaagaggcaatcgcagactgaggaacgaatgctgcttgtgtgagacatgggttgtgttagtgggaactgggaatgctaatgaatattactgaatacagaagactcctcccttttttgtaggcgacagaattgggtggtatggtttgtgttaagaaatcctattccattaccaattctgaaaataagaaaaaaccttatagaaagaaaggtaaaacgaataaataaaaacgttaacgcacattatatttcataatttccttgtatgcttgcttccaatggtattacctgcctggatctctctgttattttttcttttttgagttaagtgacctggtggatcaatttaaatttctgaaaagaatactaagataacacgattgagagtcaattccatgtatgtttagcagtaaaaattgaaattactatttattagcacgttcgccactaaatatgtagattcaactagtgctctaaacaagctagaaccgtcactagtaagtataataaaaacgaaattcttagcacatcaaatttagaaacttgtaaatcaaaatacatttcttgttagaatgaattcctagattttgctgtcaggcataatttccttaaaaaggacggtgaatatatatgtttttttgtaacaaaaaagaatgaatgcaccttgtattctagcaagatgttcttaatggacctctgcattagctattatagtattattataagaagagaaaatgcattcctttaactccaagcaacaacatatcaattgttataacatccacccggtccagaattttatatggaccggagttcgtagacacgtgtaggaaggaatttttccaaacgcgcaatgttgacgagttaaattctttagccggaaagagaaaatttcatattttcagccaagaaaataatcacgtttcatgtgtccaaaaatatattggcttctttctttttttttttttttaccgttttaaatgttttaaaattaaataaaataaatttataaaaatcaatattatattaaaaattatatcttgaataaatttttatattcttaaaaactagtcatttatttatatgttatatgattgttataattattttactgtcactattttaaaaaaatttattttgacatttatatttatttttgatacataaaatttttatttttttaaattgtaataaatgaatttcaaattaatattatattaaaaataatattttaaatacatatcattttatatatttataaaaaactagtcgtttacccgcctgttgtaattattttgattataaataataatataaattaaatttatattatacttaattaaaatatttaaaataataataaattaaatactcttaacgtcttcattagtttttttatattttaagattttattaataaaaaatataaaaattataaataaattaatagaaaaactataaaattatatataaacttgaattctaagtgttaataataagtacatgtatcaaagttaaaaatcaatgtgttagaatagagtaacatatgttaaaaagtttttattagactagatacatattaatgtttttttgttcatttacaagtatcaaaatattcattttctatatatataatatccattagatgtaatattctataataattaattctttgtatttaaatattcattatctatgaacttaatatttattacggttaatatttatgttcatttcgtttaatgtattattcattagtgttaatattaatatttattatctagtactgcaatattcattgtttatatatatataatgttcatcaatatttttaaataaaaatattaattatttatgaaagcttttattgtttttgtgatgcatattgagatttttttatgattgatataaacattcataatttataggcataatatttattagtttgtcaatggatattcgtcattgataaaaatttatttattaatttgtcaatcaatattcgtcattgatgaaaataatacccactaattcattcaaatgaatacatctaatatagatataacataaccttgaattctacttgttagtaataaatacacgttccaaaattaaaattatatgtgctaaaatataatagtatgtctttttaatttgggataattatatttttggtatctaaacttgtcaaacactgacaatcgaatagttcaacttttaaaacaaataattaaatgtgacaacctacaaagaaataacaaaataatatttttagcatgttacacattataaatatcgatatgaatttttgttatgtcaaatgacatgagaaataagagatatgtggtaaagatgtattagtaaaaataataaaataataaacttatctatcatatacaactattaaaattttatagcgcaataaataaaaagattagtgaattagaaattaagaattaataaaagttagagaaaaagaattatataagataaaatttactctaaggctattcattaataaatctactttagtttttaatgtgttgaatgatttttacttttttatttatatttataaaaatttaagaaaaatctgaaactcatctgttaaaattgttatttaattattctttgatagttgatacttttaattgttaattttaaaaagttaggtatcgttagacaaactcgaacgaaatcatgcaaaaacttgtagagaatcctaaacatgttttgggacctgtaagacgcttataaatagcttatttccagacatgctgtagcagcatcggtatcctataaatataatggtgttttcattattaaaacaaggagaaacaaaaattagagacaaaaattaaccagattctgctgcttttagactattttttaccctaaaaatgacagctttcgggcggttttaaagaccataaattataatttggataaaagtattgtactcataaaacatcaacaggaagcataaacaaacctaaaatatcctaatacagtgaaaatcgtcgtaggatgaatatattcttggagtataaaaatcaaaggccatccaacaagtaggagttctatgattcaaagcaatccgcagatttattgtaacatctatgaatatggaggaccctttcaaaggaaagagaaaacagacctaccaaaaatctcctaggagattaagagttttaaacaatattaagttattagtcccaaagtagcaataacttcagccataagaagggagaaagtcttaactgttctcggacagccatttattgacctgccttcatgattcctacagatgattgcaaccccagcaatgtctctagagtgatcaaaagcagcaccaatttaaactttaagcgacctggtggaggagaattccatctgtcacgatgcctaggttcatttacatataccctttgagactacatgaaattttcataagactctgaagctgataaataatcctttcatgaagttccaagctcagcgaatagataaaacatggccaagaggcttaccttcggaaatggctttatttctaatcttccaaatagattattaatgagcaagttttgttgaccacacacggaattgtaagaaatgaggacctattttgattcattcgggactattagcggctttccaatagcgtgagtagcaagcatgggagcaaatggcaaacagtatcccaccagagtggttagtaattagagctcagcaggccgtcgccaggtctatcttttgacattgattaatgttacagttggatacatattctgctgcaaataatgtggcgtacataaaataatctttcatttacttgtttcttttttctgtaactcactaactttactttttcttttttcttttaaaacaatattgaaaattaaaatgacctcgtgatattaccaccgtttttcctccctcctagtatttatgtacttagtgacagatgagtcagaaatgtaactgcgttgtgattgctaatctttctttttcttcttctttttctttctctttgtttccaatgtatacaaaggatacatctaccacaataagcctatgaagttgatgatgaagttgaagttgaagttgatgttgatgttgaagttgaaatggtagctggtgatcgaagaacttgttgcagtagtcgtgctgcaagacgctgactgatccctccaataacacgcccccctaggctgcgtgcctcaggttgttgtaggacctacacatttacaataatcctatcagtttccaaatgattacttacaaagattgagtccttcaattggattcctcatgcatgctacagtatatgtttcttctactggaactattaaggaatattatcctataataattttcattctgaatccattatacataacaagcgaatcctaaattttgattctgcaaatttattaacaaaataaaggagggaaatgaccaagttagaaagggcttatgaaaaatggtaggatcttaaccttcctactggaccaaaaccaactacttcaagcaaactaaagagaagataaagataaaagctaaagaagaatttgcagattgaaagtaaaacaagagtagccctcttacactggatggtgtgtattagttctatactgcaaccactttcagcacctaggttctatcatgcaaacaccatctacaatgcagccactttcaacacctaggttctatcatgcaaagcaagggagtaagagtaagatgattgtaatggaaaactaagttgagatgcatcgcatgaacatagaatccctgaagaaacggaatagcttcctacttatgaagtttcatctccatgactccatccgtaactaaaataacattctaactcaataaggacctgcatttacctgtaagataggttgcagaagcattgggtcaaaatcttcagaggatcgcaaaaggccccatatccttaagatttggtcccgaagctctatcatgctttgtatttccatatcattgattgtaagaggtctagttacactgatcaaagttctaatagtattggggatagaattgtatgtatcaacaatggtgcccacaacaacagcttcagtcacacgaacagcctccttaataactaaagttcgaagctcttcaccatcttgagctagtaatagcttcaaaacaggttgaagagcatcatttgcagagaaatctctatctttacttccttcaacaagtaggttttccagtctattccatctgcatgaagagaaaatggaattgttaaaacaagcctataacacttaagcttacctagtcaacatatataaccagatgcataaaactaataatagataaatacatgcctaaaccgtccatccttgaaaagcaactcaataagagcatctcttagatatggatttggatcagtgagaagccttttagcaaaatagggatatgaagcagccagcaccttgaaattgggatcagcataaagggctaaaccttcaagtacagtaagtgatctcaatatcagtgcataatacgccggaactgcaagtgattgagaagccaaaccatcagactacaagcacaacctataggctgctattatctaaaaacaggtctgttcctacagaaagcgtagacctagaagacctgcagtacagctatcaaaacaaagatggagaaccagaattaactcaccattaaatggatattggtaaaagaccgcacccagaccatccactagagttttgaagtttagttcactcacagtgtaactgagtgcatcatcaaagaagttttgtagcgctggtacaattggagacacatctacatcacgagacaagaaatctagagcatagtaatcacgagccatggcttcataatccctattaaccatgtgaacaacatgacctattatggcagatctagcttcttctggtgtctcactcatcattccaaaatcaagaaaagcaagcttcccctcaggtgttgccaaaagattgccaggatgaggatctgcatgaaagtatccatattcaagcagctggcggaggctgcattgtatacctgtattcactagatccagaaccttaagtccttgtctctctatagcattttgctcatttaatttcactccattaacccattccatggtcaaaattttgccacttgtataatcccaatagatatctggaacaagaatatcttccttgtcggcatacaactttctaaacctcctagcattctgtccctcctgcagaatcctatcaaaactaactttaaaaaggtctaaagtgtcttgctaaatcaattattaaagctcaatcctgtagaaaggtcataatgatacagtaatgtacttgataaaagttaaggaggctagaaatggtgagacactttgccttttcaaatttcaacaagaagcattgaggactcaattctgggtttttttttaaaaaaaaaatatgacagaataataaatatttgaagaaggtaaaaaataacctggacatagttgagctcttgataaactctgcgtgcaaattcatcaataagggcaacaacatcactggtgatgatatcaacatatttgttgattaaaattccaaggcccctaataaggtaaaagtcaagtcctatagcttcttcgattccagggcgttggaccttaacagcaacaatatgtccagaagacttgagctgggctttgtaaacttggcctaagcttgcagctgcaataggagatggggatatggatgaaaaaatagagtcgagaggtagccctaactctttctcaatgcatgaaaatgcttcttcatcagggaatgtaggcaatgcatcctgttcaattgcaaattgacaacaagacgttgaaggttgtctttaaaagccaataattattaaggttaactgcaacaaataagaaacaaccttgaggtttggatttgtttacaatttgtcctttcaattcgaagtcaacaatttaagaatttcaattggaaaattagtagagttctctgtgtaaattcgatcaatctaattttagtttgaaaaaaattgctcgacgctttaatttcctgtacagaaactttggaattgacataacacttgaaaaatggatcaaattcttttccttttaaaggttgctgtagctacaaactacataggagttttcttaaacacgatgtgacaatattgggaagaaattatagagagtttgagaaaagagaattggattaaaatcggaatagtaatcataactcaattaaactccggttacttcatttgatggcaatttttgaagttaaagctttagaattagtaaaagaaattccaggtaaacaaggaaaaggcaaaagagtacctgaagctcagagagttcctcgagatactcaggagggcagatgtcaggcctggtagacaagccctgccccaatttcacaaaggtaggtcctaatcgggtgaaaattctcctgagctcagtggctcgcaatttcttgtttatattgaaaacaccattcctctgatccagatatagtttcaaggcaaatgaactaagggctgtcaatatttcaagagtccgtcgcaatacctgtacatgtcaatagcttgagaccaaattgccagcctagtaacattaacatctatacaaaagaaataataacctcgatcggtttagacccgtatttggaggcaagcagctcggggctgtacgcggacgaattggcggcacgggccatggcccttgcctccgcctgcaggtcttccgttcgatctcctcctacagctaagttaatatctcgtgtcgctggcaccgttctcggtctcgcttccaccagagctgctcttactcttggtcttgttcttaccgtgggcctcaaacacggcccagaagtgaaccggtagccacccgccaaaacaaggctcgtcatcaccgcaagctctgctactggttaatttctgattggagacgaggcaagaattcaatgggttgcttttctttcttctatttatttaaaattattttctttcattttgttttcgtggcccccaaatggtgcgtcgtgtcaccctgactaatcacagctagatgtaaccggatacctgtccagccggtaaagaaatattaaaacttgtctttgctgtcatggtcagactggatttgggaaagtctgaggctctgagagctctaaaaagatattttttctagagagcagttttattagtggttgagatttgccttcaactgctatggcggcggctgctgctgcttggccaactggccgcatagacgtgttctggcatgaggacatgctaaaacacgatgctggacaaggcatgttcgatacgggaattaaccctgggtttctagacgtgttagaaaagcacccagaaaatgcagacagaataaagaacattgtttcaattcttaaaagaggccccatctctccctacatttcctggcatcttggaagacctgctcaactccctgaattactctctttccacacatcaggtgcctccctaaccatcacttcttcttttttttttctttttttttatctataataattatatgatcttgttgacggctatagaatcaacaaacggtgatgggtaacctatcttgaaatttcaaatagttttcctattatctaggagcttcactatgccttctatatactgcaactttacaccagttattttttatttaattaattgctggagaaacatgccaatttgatttcttgtcctaggccagagttcaactaattgcaagagaactattatcattatgttttctcataacaacaaataataatactaatattaataaaagcaatttgttgtacaatttggtaactacttttctatcgtgcgatttggtagtttaggtcatttccgaattcctttttctgaatgtcatatattttgcagactatataaatgaactagttgaagcagaccgggaaggcggaaagattatttgttcttctactttcttaaatcctggatcatgggatgcgtgtcttcttgctgccggcacaacattatctgcaatgcagcatctgcttgatggtcatggaaaacttgcttatgcattggttaggcctccaggtcatcatgctcaacctacacaagcagatggatattgtttccttaataatgcaggtcttgctgtccaattggccttggattcaggatatagaaaggttgcagttattgacatggatgtgcattatggcaatggaactgcagaaggtttctatcactctgatagagtacttaccatttctcttcatatgaatcatggctcatgggggccaacacatccacaaaatggatctattgatgagcttggcaaaggagagggttttggctttaatctaaacataccactgcccaatgggacaggcaacaaaggatatgaccatgccatgactgaattggttattccagcagttaacaagtttgaacctgatatgttagttatggttgttggccaagattcgagcactgtaagttccttcagtttacatacatgaatatatcttttcttactgtaacatgacttgaaaggagaataaactgttgaaaaggagattgaagtgctaaagtgttaaggactaattacattgaattatgttaacagctaaatagtcatggaattaggaaaacatgaacttatgtttgattgatgatatctggaaaaactgttggaatcctaataaacacatggcaccaaatcgacggggctgttaagcttggaagttgagtgctagtgattgttaactttaagaagtctgttaacatggtctcttctattcgtagtttgctagacattctgtttaaatagcgttgtactacacaaattacttctgcagtggttggataaccatttacgaagttgatatgaggaatggttactcatttttgcaattttatcctattttcaaaatcagtagcaattcatcatatcaacttcgcaaacggttacaattttttacatgcctttttgggagtttgcctttattgggctgtcattactttcatgggattaaaatttctgacttggaaagttaattaaatatgctgtaaacccttcaaaactgaccatttattaatatcaaatgcaccattttgtataagacaaaatggtgagttttgctcagagatagaaaatgtcaagagattagttttagtttacttttcttctttatttcttgttttccttatttttgtactgccattgttctctcttttcttttgtacttctaaattgttgctttcgctaaaagagtggttctacaagggagttaattgaagagagatttcatcccttgtggtcctaatagtgacaatattagtgaaaaggtatgggcacaagaaggaaaaatttaggtgataaacaacccaaattcttaaaatcaacaaagccacaaatataaacaagccatttcaagtaaacaaatatgtaaacgtggatatatcaaaagcaaatgctctctattttctttgattcttaaggcaaacaatcgtgtcaggaattcacttaagcagttgctagggttgaatatctcagttttagaatgtagtcaatagattcaaacaatcccctcaattcagtcaccttaattcaaagcagcttttgcctaaattgatttaccctaactatttaccagttgaataagcagaaaactgtaagtcaaatttggaagagaacttccctttttgttttaaaagtgaaactcgccgttttgtattatagaaaggtgaattttaagttttaacttagctctttctggcgttccagcttgacccaaatggaaggcagtgcttgactatggatgggtaccgagaaatagggcgaaagcttcatgctctagcaaatagacacagcggaggacgtcttcttattgttcaagaaggtggatatcacattacttactcagcttattgtcttcatgcaacccttgaaggtgtgctcaaccttcctatgcctttattatctgatcctattgattgttacccagaggatgaggcgctcgcgtttgaagctattggatccattagaaagcattacaaagatattgtaccatttctaaaaggagcttgatttggatttactgtgtatgcatactttcaattatttatcacatggtgcattgttattttgttggagttacttcttcaatagtttatcacatcctgaactgatttgccgatgaggcttagcctattactcctgagtggggagattttttaggtcaaatctcctcatccactactattggtggagtgtaaggtaatagttgcccaagttgtgtatccatatgtctcaaagatgttgggttttcttaaagaaaaaaaaaaagaaaaaaggaaagaaataatgtcatccacgaatatctatacttcaatctccctctagaaacgtcttgttacttaaaaggtttgtgatatttctcttttatcattttagatctacgatttctagttctcttgttgcgttgttagtatctaaaatgtaaatttattcaggttggagaaattgaattttcaattaaaagtataatacaaattaatagaaaatactaaaacaaccggtaaatctttgaattttaaataacatttgatgtgttttttattttaatttattactattttctccttttatctaataggatttcaatgttgatgttttttttataattaaatttttttttgtcattattatcttaaaaaatatattctactcctagacatttttttaataatcatatatctaaaagttagtagttatatgaattttgagaaattttaaatttttataccatccaaaatggaagagatgaattaaaatattgaatttggtaataaaccatgtcatcgtgggttggggggcgggtaggtgcattctagaatttgacagcagaatctggagcaaaataaaaggtaccaaagcctattctctaacggtattttgaaaatatggatgttcccgccctcacttccgcatcaaccattacccaactccctcaacgttttaactctaaaccaacgccaacgctgacaccggcacctccaaatctacctccaccgtcacacctaattcaacatccacgcactaatctcaagcaccaatgtaatagatccatagacctcactattgcatggacttcctccatttcccgccactgctgcaatggccaactacctgaagccgcctcactcttcacccaaatgcgtctcgctgccgttgaacccaatcacatcacttttgcaactcttatctccttctgtgctgattttccctttcaaggcaaatctattggcccttccattcacgcatatgtacgaaaactaggcctggatacgtgtaatgttatggtgggtactgcgcttgttgacatgtatgcgaagtgtggtaaggtccaactagcaagattgatctttgatgatctaaaggtcaagaattcagtgtcttggaacacaatgatcgatggctacatgaggaatggagagacagggagcgcaatggagttgttcgacgaaatgcctgaaaaagatgcgatttcttggactgtgttcattgatgggtttattaagaagggtcatttcgagcaagcactggaatggtttagagaaatgcaggtttccaaagtggagcctgattatgtaactattattgcagttctttctgcttgcgcaaatttgggtgctctcggtttaggcttgtggatacatcgatatgtcttagagaaagagtttaggaacaatgttaggataggtaattcgttaatcgatatgtattcccgatgtggatgcatcgagttagctcgtcaggtatttcacaaaatgctgaagagaactttggtttcgtggaactccattattgtgggttttgctgctaatggttttgcagaagaagctttggagtactttgggttgatgcagaaagaagggttcaaaccagatggagtcagcttcactggagcactgaccgcttgtagccatgctggtatggtagacgaagggctcaaatgctttgacattatgaagagagtgcacaaaatatcccctagaattgagcattatggatgcatagtagatatgtacagccgtgctgggaggttagaagatgcattcagcgtaataaaaaacatggcagtgaagccaaatgaagttgtcttgggatcattgatggctgcttgtaggactagcggagatgttggtttagctgaaaggttaatgaactatcttgctgatttagatcctggtattgactccaattatgtgttactagcaaatacatatgcagcagttggaagatgggatggggcaagcaaggttaggaggacgatgaaggcccttggtatacaaaagaagccagggattagctcaattgaaattggatgtggcattcatgagtttgtggctggtgataaatctcacaatgaaaccgagcatatttatgaaatgttggagcttctgtcgtatcatctaaagttatgtggttatgttcctgaatccatagcaagtaatgtgtctgaaaatgattgaaacactgtcaagttgcaagagaggaaataatgtgatttgaagttgctaagctagtgagagaaatctatccatatctctgttcttgtaagtatagcattattagtttttcatagtatcataagacatgtaaatttattagcattttacctttaacactgttaaccccaaagagctcgcaagatcactttgcaattgttatgctccatcagaactatcttagaccgctgtcttttagggaaaatataatgaaattattaaaattactgtgtaaaatattcaatcaatccacagtatgaacaattgtaagcatgaaattgaggacttatatgcctgcaatatttgttcccttctgatcttaaaaccttgtttttttcttgtggcctgatgacaataaactggcagagaaacaagcaccgacgccaacctgatttgaagaacagaaaattctcacattgacaagcgtccgtgttggtagaagaaatagaacggagttttccactagttggtattagcgatggaatttgaagatgcaaacacaaaatgttactcttcacacttgaaataataatttaattactgcacctgtgaaacgctagcgtgctttgctgaatgacagtgttatggaactttggcatcaaattattagaaaatgaacggtgacacgcaagtatcttcttcataaatacaactcaaaaagaaatttatagattgcaattccaagaataactttgatcccttcaaaaagaagggatcaacaagaagtatgaattgcagagtatgccaaaggcacaacacctccagcgtcacgagatcaaaagatggttaaatgcacactggcagaagtttttctccaaagtaaaataatgagggtctcccaaattctttgccgaaaatctgttctgggccccaattaatactcattcacatccattattgcatgttaacaccaagtgaaagttccacttctgcacaacgtcattgcaaccttcctcttgcattacaaggaaataaaattccgtggtctgatgtgagagttaatcccatgaacaaaccatgaatataccatatatctccaagtaaattccgtatggacaagcaagaaaggaagagaactaatcatttcatcttaagcgcagcaactaataacgcgcattcttcccgcgtgtcactaccccgttcaatgcaacataggtagaaaggcaatgtaggaagtccaatattggtgaaaaaacatggcatatgtatcggtcaagtgaccttaatttcccaaaagatacaaattaatcccatctgctcgtcatagtcatataaaaacattcctggaaactctctcagctacgtccaccttcccatgaatcttacaagaacccagcaacgcagcccacaacacctcatcaggttttatctccatcctcattaccaactcctcagcctcctccacccttcctgccctccccaacatatccaccatgcaagtataatgctccaagctgggcttcactccaaacctctcctccatcatcccaaaatactccgcacctttctccaccatcccgccatgactacatgcactcagaaccgcagtaagacacacggcatccacactagatccctcttccaccattctgttaaacaaaaccagcacctcaccacctttcccatgcattccatacccggccatcatcgttgcccatgaaacttcattccttgcaggcattctatcaaacacctttcttgcccccgctaaattcccgcactttgcgtacatattaattaaagcattggaattcgctaaatcaaaagcaagcccatttattaatagtatcccatgaacctgctgcccaagcctaacggcggataacccagcacaagatttgaggacactgggcaaggtgtggcgatcaatgggcttgcaggcatcgagcatgcggcgaaaaaacgagagagagtgagagaaaaggttgagagatgcgtaagctctgataagggagttgaagaggaaagtggtttggcgattggtgaaggagaagaggagagcggcttggcgcatttgggtgcaagaggcgtaggcagagacgagttttgagcgaatgaaatcgcgatgataaatgccatttgtgatagtttgggcgtggatttgaattaaagttgtaaaattcttggtggtgatgcaggcgtcaataagagacgcgtacaagggaatggtggccatatagcataaagcaaataaaaggctgttaggtcattgatgatcatacaatacaagtagaagaactatcgttgccttgcctgctctgtctaaggctgcttctaaatgatggtgtacttgaagacgttgccattgcttctactctagattttgggatggttaaaatttagggtttcaatttagcataaaatcgaagaagaagaagaaggagagagaacagtagtttaggatatgggtccataatattacatatcagtcaaagtttggataaagtgtcaaatacacttgaacttccatacatagatcaaataaatccaattgcaaaactcttttcaaataaatgggcacacacaacttctattttagaatcaaataaaacttgcttccagtgaattcccttaatcaagccactgtttatgaatcgcgggctcattctggtgagagccccagactcctcccatcgcttggaagcttatagtttcatattctatttcactttgtaatgagtttaatttatcctatacgtctagatcattctctaataaaaaaggataaactaaacatatcataaataaataataagaaatgttttcttattcttttagttctgctttaccaacaaccattgctaaaagaaaaatggtggcaaattgcccattgcttcccttctctaatgccactcaccatttatagcttcacctatttaaccattcacaacaccataaccatcgaaccactgtaccaccaccaccatcaccaaaaccaccatcaaaataattattttcacatttatttaaaaaaaattatctaaaaaaatcaatatagctccataaccaaaaacatcaatgataatataattaaaaaccaaatactcaaagtcacaagtgcactatatatttccttttcaaccaacaacaagaacatgatctccaccattatttacatcatcaacatctctgatcaacagtttcaacaagttgagttatttaataatagtcgttgttattgtcgcctttcatctcatcaaatgtcgacagctacttgtaggagctaatattgacggtcactaaatttgagtccttgtctgagtccataagaaaggattgaagtaggaggttttaaattgttcaaattggggaagcgaaataggggtatatctaacaagtataatttagtaaaaaataataaaaagattatgttatcaactataaaaaaaaaaaaaaaaaaaaaaaggtttcttttttatctatgaatgaataataaactatttctttggatggaaaaaaaaggtgaggacttttatactctgatcattagattttgaaaagtgtaacataattagccttaaatctaaaacgaatattcttttattgataaaaaatttatattattttaataaaaaatgctgttaataggtaatataatttaattaaaaactaaattataatttctattagttattaattcttaataaattaaaatattgcttttattataatatcttaacgctttatttggaaaagaaaggataagacaaaaaaaggtgcggaaagaaaagtaatgaaaagaaatgataaactcaatatgtgaacataagaaaagaaagggttttcttatcctttatattcagtcatgattaatctaaaaaaaaaaacagatgagttgtatgattactttatttaaaataaagttaaaatattttattttaaacactatataaatacgtaactaaattaaattttatctattaaattttataagtaaatgtgatttgtaattcattaaactcttttcataattttaactaaatcactataatttaattgtcacgacccccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaataattaataaatcacgcaaaccatacgtgtcatgtcaaaacatatgtatcatactatgcttgaacaaaaattattccacacgcaacgggatggagtacttcagtagaaccctaatcccaactcaacatctcgatcaatttcaaaactcacctctcgaccaagctcaactctaatatctcaactctctcattctaacaggactggcgcccagagagcaaagctcgatcagggaccttacctccagcctggtcacttatatctcaactctctcattccaacagaactggcgcccaaagagcaaagctcaatcaggaaccttacctccggcttggtcacttaactctcaggcttagcctttcggctctcttatccaataagactggtgcccagagagcaagttcgatcagggacctttacctccagtatggtcacttaaattttcaaataagccggcgcccagagagcaaagcttgatcaggaacctttactccggcaaccacactcaactaagcctagagagcgatgctcgaccagggcaagtcctaatctttctttcttaaattttttacctctttaccctttccctatctctctcagatttatattggaacactcatccaactcatatgttctattgccatcccatctcgagtcatcatgcaatattaaaattggtgataaagaaaaaatatatttaaatggtaattaacaacatcatgcaaataataataataatcaaatgaaagattgaaattgcaaatgaataatcacagtaacaaatcaaattttatgcatgatacatgcataagcgatatatgactttaactcgcagatttggcgacctcctaactctgctccggtgcctcagttggagcgagccgaacaaacggactatttagtcacggaaaataatttatcaaaacgctgaaacaattgatcattaatcctaggtctagactcctaggactcactgcctaagaatctcaactcgggagaattctaccgaaaatccggcagaacctcccctacaacacggacataaccccccgtaaaaacgggtctaggacctgccagaaaaatacttcaaatattcaacaattcaaacaacgggagtcgggtccccaaacttcactatttttccgactccgccacacaatacaaaacacgaggcaggcaaactgacagataattattttttactcacaaatattaaatacacaacataaaacaataagcacaattctaaatcaaaggatttccaagatcaacgggccagagaaaattaccgagatgctcggtcgactcgcctctggccgccggagtccgatcgacgatccgaacacaccatcggactcacaacgatgcgctaatgactatccctgtttccgattttccgatctgacacccgatcgtccggagagatttgcagacgatctcgaccgtcgatttgcaaacgaagctcgatcgccatgaaaccggtgccattgcgaagcttgagctgaggagagtcgggttatgtcctccgatcgtccatcctccgccggagctcgccagaaaatgcggctgcctccacttcaccggactctctcctccggccaccaaaaccgacgccgccaccgccaaaatgaagctctcttcgacggaagccgatcgccaccaagatcggccggaaacggccagaatggccttcgaaagccgttgcccctcttttttttttcctcgctgctaacgccgccgccgccgctgctggactcgccgacgccccgatggacgacgccgccgcctcttccttcctcttcccgacgtctccctctctctccctgatccttctttctttctttcaatatcgacatttgacccctgaactttttcttattacaatttggttcctcaactttcttaattacatacaatttcatccttcatatttccaatttaacccttaaactttcctttagtctttcaattaagcccctaactatttaatttgggccaaattagaattattgaaaatacacaattacgaaaatacctctcaccgacatatttatttataaaaataccaaactcacaaatttccattaaaaccccataaaaataaaattatactttcaatccttattccaaaataaattttcaatttagtcctaatacaaaattaatttaaataataaatttccaacttaaaatttaataccactaatcaattaaaataccaattttctcaaaattcttttataaaaacatcccttacaatttctaccataatttttccaatatataattttatttatacatatacatatacattggggaagaattaaaataaccaaaaatatattctactcttcaaataatttacttaattaattcttaaaatttcaactaattgggtatagaaaaaataattcattcaattgactaatattaaaatttccattaaatctttttaaattaaaccaaataaaaataaaactaaaattaacttaaatagaaactcattattaaatatataaaactttcgggtattacattctccccccttaacaaaaatttgtcctcgaattttaaaagaaaaaggagcttcacactaagattgaaactaactaggaacctttcatctccaactcggcttctcgggaactttcctccgcaaaaataaactcaatcacaagatccaacgataaaacccttaaacaaatctggcgaacctgagaatcagcgatcctgatttacggctcctcggaaatcaaatctttactcacatccacacactgaggatctaacacgagcaaaggattgaaaatatacttcctcaactcagacctacaaacaactagatttgacctcagagaacattacttggcggcaagtctaacttgcatgccacctcaccaacctgccaacaaaaccaagggtttccacataagaagagccaactctaatcctgccaaaaatccacttgccaacttctttcctaaagacatgtccttacacgcgcagaaaattcttaacatccacatcacatcatcctcgacataacatccatctgatcgcatcaaccgacacaacccatgccatcttgacacaaaattcctctttgactaaaatccaaaagcctcctttataatccaacatggggcttacagcgccacagacttactctcacggcaacttagctcgtcatccagagaatttccaagctaacacaatttacttttaaaaaatttactctcactgataaaagctttattattgatataagtgaccagattggaggtaaggtccatgatcgagctttgctctctaggcgctagtcttgttggaacgagagagttgagatattagagttgagcttggtcaagacgtgagttttgaaattgatcgagatattgagttgggattagggttctactgaagtactccgtcccgttgcgtgtggaataatttttgttcaagcgtggcatgacacatatgttttgacatgacacgtatggtttgcgtgatttattaattattttaaaattaaatgaatgtgatattgagacgtttgaaactgttttagatatatgattttagctcactctcgagactgatagtctccatttactgtttttcagattcgtgactgttagtcttcccgcgacttttactcagtaaaccgacttcttcatcatcaggtggtgtttgatttggtatgtcaaattgtaaaaatcttagattctccgcagtagtaatagtagatgtatcagttgtaaattttatgagtttcgggtctcgcttaattttttttggcagaccgaattaattataaatttaatggttgcgaaattgtggaatcaatagtattaattaagataagatttgtttgagttagtgagtgtcaggcttactacggaattcggtggctttacgtctacccattccctagtgccggtcacgggcctacggatgaggtcgtgacattaataatttataaaaaaattaataaatttataaaaatattaaatttttttaataatataaaatatattattaaattacaaaaaataataataatgtttgtattttttctcctaatcccctatattccatttctttctctagctttttccctttctcaaacaaggctaaaagaaaggccaactagataatggactgggtaagcaagtttcactgcctcagtcatattcttgcttctcccctcacttcctcctgctttttgtcaggcctacctcttcgatgaccaatgatattattatcattcctataattttttaaagaagaatggaattctttttccaaaactattgataaattgttagtactatgctgaagattttctcagagtggatacatagtttgagtttttttggttcataggatagatggaggagccaccgattttctcagacctttcgtttttttgcaaaaacaattaattatgatcagtttacatattagaagtgattgaaatgaaaggagtgactgtcatattatatatagacatggcactatcgtcatcaatgtcacatcgatctccactgtatatatatatatatatatatatatatattttaagaagctcgaggttagttattgcagcatgtttgtggcaggtcatcgatctattgattctattccaatcaggaaagttatagaatgacccacaaatagtcatacttgacttggacactgcctttcaactcatcaccctaaccctaaaacaatcacatctaacatacaggaatagatttaccttactaaccacactaattaacccaacgcttttgtttttccaattttaacacaaggaattgggctcactttataatcccctataacttggcctctagtttgtttttccaattttaatttaactttttcttataatattttctcatcatcaagcatccaaagaattggcagattaatttcaagattttttttttctttcttttcaagaacactgcgtataggcttttgtttttaagatattagttaattatataacaaaattacatccataagctgacacaggaaactaatacatgtgtatatatatatatatatatttatttaataaaatcacgagttcaactatatataataccaaaacctgcatacaaaattaagagagttaccctccctaacaaacagggaaaacttaaaaacaaaagccagagtcgagtacacttgtagagaagtactactttcagacgtaggttttttattagaggagtcatggagttgtcggtttcttggggttaccaccattatggtgcaaagggtctggtccagagggaaccgtcctcaactcttccacaaccaacttctcaacatttaaattgcttcttgacgatctcttggaaacaactagtacctacacatagataataacaacaattacttacattctcaatccaaaatatatagatggatagattatctagaagggaagtaaacctttctgccttgaatatccagaggaagtgttgcttttggatataagcacctcatgacatggccagtatggcaacctgttaagacaagcaagatcatgaaagttcaatactgtgaataattgcaatgagcatgcgcatgcatatatggtataagaaactgattaagatgagtccagaccagaagcttcttccataactaccagcaagagaaagagcaagaccaaaagagagtagaacgtgggtttgaaagccatttttaattcaaagcagaggatatatgcagaaagcgcaagttaaaatgaaagacagacagagagagagagagagagaagagaatgggcaatttatagagcacaatgacagaaggttttcattaatttttcaattatttaaggaaaaaaaaaaacttcatatatatgcatgcaaatgattgtccaagcagccatttttggagaaattattagagagattctgtactcgagagatcctctaagtctcaatctataatgagggcccactaatcacctgacggcgccgtcttggttgagggatagccatgagtactgggacgcagctgcaagcaatatcagatgtatctttaaacatatatatttatatatcagcaaatggcgtcattgtacatttatccgaacgtaccatatatatcttccagtttccgttatccttgtgacatcaccgtttacacctgattcttatttctggagtctgatggaaatatttgtgtaagaagtaattagaaagattttggtcacactacagctggactgggtcattatctatatgtatatagtttaaagtgacgatgatgatgatgatgatgatgcctttattttctatcaaaaattgaaaaaaaggaaagtgatagaatggactgattgatggggtctttcttcttcttcttcttcttcttcttctttattttttaaaccttttgcattttattggttcgtattagaaggcagaagatagtgttgcagtaataacacccccacccttaccctttttctttatcgactgctatgtttgaatcgatatgatattattatataggtttgctacatcatgaaaccgctaatacaatcattacctattagaaaactttagatttttggttattatgctcttgcgtttaatttacctgtctttactcgtttgaatattagtttagcaattgaacttgaatgtgttgtcccatgaagacatgtcaatttttctaaaaactaattcctttcccctcttttattcatctctcattgtttaaataattataagagttttcttctgtctgttatatattactaccgacagttatatgagccataagtcacataccatgcataattacttttctataaatttctcaatatatagatgaattgtgcttattaatattatgaataatacatgaaaatattcaaaattgaaatctcctttttctcgcactatggaaaatactagtcagcccacttacccacttactaatctaccaacaatattaatcttaaaattaaaatagtattgttagaaaacaaataagaatttagtaattcatatgagaaacatgatgtatacctaaaatgactttaaagaaaatatatgtcacttgatataagaatatatttatatcgaaatgaaaagatttaatacatgcttatcacttatctatttcttgcaatatatataattaatattactaaaaattgcctaactttttaagtgaaaactacaagaattactttttttttccttatatctattatatgagtgaattttagagtaccgtagttacagtatatttttaatacttttatatatttatttaaagaaaatttataaaattcagatcaaatctacataaaatattttaatatgtaatttttatataaattatatattaaaatatttttacataaattttttaaataattttttttatataattaatttaaaattttcagatggaaattgaccatcgagtaaaaagatagaagggagtcgagtacaaagatagaagggagtttgactgcaaaatccacccatcgagcagggatgaaagtcggctttataattaatctttattcaataaatatatataaatattgaatgacactttaaaattcgtgcgtttcatttgtttagtttttaaaacttttatttttattttttttatattttcttgtcattttgtttttctttctacatcttcttttccttttctccttatttcttttgtttttgcacaccactgcaaattaattatcttgtattttgtgttccatacttgattcatatattgagtaataagaaatctgaatttcatcgcaacctaccgtgcaataattattaatcagacatctcatttatggttatagccgactgagttgcaacctagtcgactcgccaactcagcaacaacaaaaacataacaatgtggataggtgagtcctacggtttaagtaatttcgtttttattattttaatttttaacgtaaactaccaaattgctgtatttctatttctgaatatcttccatccaatgttttcacaaattattctgattaataatttctccttagtactatcaatatggtcagaaatttgtgatatcttgtatttaaatgaatttaatttgaagtttattattttaaatctgtattgttgatgaatgcagtccaaatatttaataaagtggagaaggcaacagactgacgctttaatgcttttttggtaagtcatccattaaccagtagccagagaaggcattagttgttctttagaagtatcggtatgaaaattgagaagtggtagaaaaatacccagtgataaggatgatttcggtgaccctaatttgacgagatgagtgaaaatggaggtaacaaagggaaacagatggaagtgatgtgccaagagttgttaattgttataagaaaagaaaagctgaagaaatgattgtaggtactcggtaataacattacaatgagtggatgatttctcttatagaggccaaacatatcataagggttaatatataaataattactaaaatttatgttaagttttattttaattataaaattttaatttatttcatatgtttgaattatattctattttagttataagattttaatttatttcatttataaatttaggttgtatgacataaataatcactcaattttacacttatttttgttttatcataaaatttaatttatttcatttacgagtttgggccatgtnnnnnnnnnnnnnnnnnnnnnnnnnnnnnnnnnnnnnnnnnnnnnnnnnnnnnnnnnnnnnnnnnnnnnnnnngtacatatgaacgagataaactcgagttcgccacattattagctcggtattaatataaataaggtaagctcgggttcaactagatttcaagctagttaagtgagctcgattttatcaaatatgcagctgtaatacctgagatttttttttaaaaataaaattttaatgatctaccaggggtattttagtaaataaatacattgatggttaattgagccttttataaaatatttttataaaataataataataataataataataataattaataaggattgtgacgatgataataataaaactagaagttttagaaatttaatatatgttattagagtaaagaatttttatttaaaattggatgatttataagagatcattattgagcccttaattcttttaagaggataattaaatgctagagaaacataaaaggatctattagactatatttaattagtatgattttataattttatttatatagtctaaggataattatttttagatgaattgcatttttggaagctataaaaatacttttcttgaagattttagttggaaaatgataaaaaaaatatttatctaaatggtactgaatttaataaaaaatagttaataaattaattaattgaatgaattaggtgctaggattaagttgatatttatgtatgagaagggagctaaaatcaaaatttcatttaaaatgggtttaagtagaaaaataccattgttgatatttttataattaattatgttggtaagggtattctagtaattctaccattaaagacaaggctaaataaataattatatattttaataattataatttggcacaaaagtgatagttaggggcttaatttagacagtaattataagcttgagggtttagtgggaattttctaggggtaatggttatcaaaactaaaaaggagggaccaaaagtggataaggaaaaaaaaaagaagaagaaggaggaggaaagagagagagagagagagagcttaagggctgcctttaaggacaagtagacgagaagggcttgtaggaggcggtgcagctgatcacagatgcagtagaagtcgacgaccatgatagcggcggcagcagcaaccccaacaggtggtagacaaagagaaggccgtgtatatggcaaccatttattggcgtcattctggcatattctgacgaccaatagcaatgttttttgtcttaaaatgaccagcaatttgagggctttgtaatgggagcaacaacatcgaaaatattggctagagctagaagttgagatggagagagaaagtggggatgttttagatttttgaacttctcggtcaatgttgttaagtttcggatgaccagaggacatattcgggacctacacaccacaagctttctaatgacactaattttgcagctatcggactctgttggaaaatcgacggttggggattgttcgtgattttctcggatgatcggggctggatcggagaatcagatactagaatcatcgtgtgcgcgttgtctcgagtctgtaggcacgctcggatcgtcgatcagactccgacggctgaaggcgagtcgactgattttgtaatacccggaatttttatatatttaataatgagtttttatttaagttaattttagcttcgtttttatttggtttaatttgaaatgatttaatgtaaattttaatattattcaattaaatgaattatttttctatacctaattagtttgaaattttaagaattaattaagtaaattatttgaagggtagattatattttttattattctaatttttctccaatgtatatgtatatgtataaataaaattatatatattgaaaaatatttgtagaaattgtaaaggatgtttttataaaagaattttggagaaattgatattttaattggctagtggtatttaattttaagttggaaaataattagtaaattgtttatttaatttaattgtgtgttaggactaaattggaaatttattttggaataaggattaaaagtataattttatttttatgggattctaatggaaatttgtgagtttggtatttttgtaaataaatatttcggtcaggggtatttatgtaattatgtattttcaataattctgatttgacccaaattaattagttaaaggcttaattgaaaggataaaagaaaggttaggggttaaattggaattctgcaggataaaattgtaagtaattaagaaagttcaggaactaaattgttataaggaaaagtttgggggcttaatgtcgatattgaaaggaaagaaaatcagggaagaagagagagagagagaacgggcgtcgcgcgtgaagaagaaggaggagccggttgctgcgtcgtccgacagggggcggccgactgccaggcgcgcgatgccgaccgagggcgctgctggagtcggcgagcgcagcattagcggcggaagcggcaacgtgaggtggcgaaatcgcgcgaagtgtggcagcggcttccgagcgtcgttccggccaatctcggtggcgatcggctcccctcgaagagagctttattttggctgtggcggcgtcagttttggtggtcggaggagggagttccggcgaagtggtggcagccgtgttttccggcttttccggcaagctcaagcttcgaaatggcaccagtttcgtggtgttcggacttcgtttgcaaatcgacggccgagatcgttcgcaaatctctccggacgatcgggtgtcagattggaaaatcggaagcggggatcgtcgtcaacgcgtcgtttcgagtccgatagtgagttcggatcgtcgatcggactccggcggctggaggctagtcgaccgagcatctcgtaattttctctggcctgaaattttagaaattcttggtttaattgtgtgtctattggtttatattgagtattagatgatatttgtgagtcaaaaataattgtctgtcagttgcatgcctcgtgttttgtattgtggtggagtcgggaaaatggtgaagtttagggacccgacttctgttatttgaagtgttgaatatttgaagtgtttttctggcaggtcctgaacccgttttacgggggggtaaatgtccataatgggggggaggttctgccgaattttcggtagaatttacccgagtcgagattcttagacagtcagtcctaggagtctagacctaagattaatgatcgattgtttcagcataattgataaattgttttccgtgattagatgatctttctgttcggctcgctccaaccgaggcaccggagcagagctaggaggtcgcccaattctgtgagttaaagtcatttaattattgcactattgctaagtctgattttaatatgctattttagaatctgtgcttaatataattattagtatcgcaaaataaatgatttcacttaattattaattattgaaataatataaatatttttattagtaacgttataataatacaaacgttattatttttcctcacgaattgcacgttgttttaccctaaatctttaatctttatttcgatatgtgttggatgatttcattagacaatgatatttattatatgtgatgatttcgatttagggatgtgactttcgtagaacatgccacatgatgggttacatcaggaccgcgtgcgcaccggtaatgatcatggatgggtaataaattttttatgagttcgccctagtcgagtatggctctctgggctgatttgagtaaattgcggtaataagattattatgagttttgccctggtcgagcatggctctctgggctgatttgagtgaaatgccggagtaaaggaccctagtcgagcttcgctctctgggcgccggcttatttgaatattaagtgaccggactagagttaaggaccctggtcgagcttcgctctctgggcgccggcttatttggatacttaagtgactagactggaggtaaggtccatggtcgagcattactctctaggcgccagtcttattggatcaagagagccaaaaggctactagaatttggggattagggttctactgagccactcgtcccgtaaaagtaaaaatatattttatttatttatttatttggtatgattataatatgaattgtatttacgtgcatggtttgatatactgattcgaataattaatattttctgtgaagactgcaatagtctctagattatttgattttaactcactctcgagactgacagtctcaattttatttttctttcagatgtgtgactgttagtcttcccgcgactcttattcagtaacccgactccttcatcatcgggtgatgtatttgatttggtatgtaaattggtaaatcttagattctccgcagtagaaatagtagatgtatcaattgtaaattttctgagtttcgggtctcgcctagttcttctggcagaccaatttaattgtgtaaaatttaatgttactgtaaattatggcgttaataatagtaaaagttgagatgagatttgtttgagttgtgagtatcaggcttactacgggattcggtagccttacacctacccattccctagtgccggtcacaggcccttgggtggggtcgtgacagatttatcaagtgtctcggtaattctctagtgttttgattttagaaaatgttaataaaaaattatattggttattattggagaaaaacaattcaaagtatatgtgtaagtatttttcaaaaataaaaatatgtgctatcgaaattgagcaaaattgagcaataagataattttatataagaccttttatttaattgcgttagaactattaataatatgaagctaaataatttgaataaataaattagtggaccttaaatggatagctataaattctagtaatttattttggtatttgcaattaagattttggctaagtaattagcctataattaaaaattgattttgttattgataaatattagaagtgtttctggcaggttctggacccgttatacgggaggtaaacgtccgtattttaggggaggttgtgccgaattttcggtagaatttccgggtcgaaattcttaaagagtcgattttatatgtctaggtctagggttatttattaagtgttttatttttattgattgaattgttcccgtgaatagataatccatcgtttcagcccgctccacccgaggcttaggagcagagcaagggggtcatcaaaattgtaagttaaagttatatatctgctacatgtgtgttatgccaaatatttatataacaatttcgattaacaattactatgtattttaatatcaccgtattatatatatatatatatatatattttgttatggtagattttgctgaatttattagtttttattctatatttaattattgatttatagatttaaattgtttattatttatctaagttggttgctatttatatatcattttccacatcatcgatattatgattgtatattgacttgggatgagacgacagtagaacatgtcatctgatgggttatatcaggattgcgtgcgcaccaatataaatctggaataggtaataaaagaatatttttgagacttgccctagtcaagttcaactctctaggctatgatgatttaattaccagattaaaggtccctggtcatgcgttgctctctaagcgctggttttattaggaatcaagtgaccaaactggatttaaggaccctggtcgagcctcgctctctgggcgctagtcctattggagtgcgagagccgaaaggctgttagtgttggggttagagttctactgaggtacttgtcccataacgtttaaattgtattttactgaattatgatatgacatgtgttttaatatgatataatattttattatttgattaaataaatattttattgagatagttgtatgtatttttggattatatgattttaactcactctcgagactgacagtctcaaatttttaattatttttcaggtgtttgttagtttttccataatacttctcatttggcatcccgatctccttcatctttgggtttaatgtaactaattttatttgtatgtttgatttttagagttctagattctctgcactaatgatttcaaaacttattattttattttggcatgttaaactaggtattgctgatagactgaattaaatatgtgacttttgggtggttaaaagttagttatgaaatagtgttataatagatagaattatactttgattgagttagtgaatggtcaggcttgctacaggcttcgatggccttacatatacctatttcctagcaccggttacgggcccacagttggaatcatgatagtagctgtaaattttaaacttataaataaattatgcataagccaaatatacatataaatttgaaaactaaaataattaaatcaagttcttgataaaagaaaaaggagttcaataaactctatagaatcctatctcaaactcattccaattacatttataatttgacgaggaccagcagtgcaaatgagtcgagtctagcttcaaaagcttcacattaagtatattataaaaatatttacacatgttaatttataacactacttattccattacttttcttttatcaattagactataatgcattttatgttaacttataaatattttactctatttacaagcttcacattaagcatattacaaaaatatttagtcatgcttcgttaatttacaaatgtacagactataattttcgaatatctctaagcatttacataatatatgtttgtttattcaacgctaaaattatgtacttttatagtaatatttttaaacatttatataatatatgtttgcttattccgcacaaaaattacgtatagtaaagcaacatagtttatgttgatttaagttaattatattatacacaaaattatatattttttatatatattattttatattccacttaaattaattatgacaagaaataaatgataagaaattaataataattaaatgcaaacataattataatattattaaattagcatttgcataaataacattgaaattattaaattagagtatttataattaaaatataatttgctgatatatattgttactttattgtaataaaaattaagtttttatgatctatttatttatttatttattaaggtaatgcacgagttagttcacgagttcattaaacgagtcagcttgcgagctccttaaacgagccagctcgtgagctcagacgagccgaacactactaagttcgagctcagctcgtttaataaacgagctcgaaaataaaactcgaactcgactcatacaaacgaatttttaacgagttaaatttgagtagctcgctagcagcccgatttattttcagccctactgacgtgatcagctaatgaaagcaacagtagtggttaaaagaatgggttactcagctaatgaaagcaacagtagcggttaaaagaatggcttatttaccttatcaatgaagtttttgcatttgagaaattaggatcagggatcgtaactaattaataatgattttaagaccactggtttcatctttctttgataattaaatttgagcgtcttttagttgtctgtgtatctacatattgatttttaatattatatatatatataagagattaaaagacaagaagatttagatacaactttgattgtattttacataactatacgttagacattgtgaaaaatcacttaaatagtaatggcacaacagcctacaaatgtgaagcaattcctacattcttggtaactcagcactgagctccatacaacaaatgggatcgtagtacattcttggtaactcattgaactccacacaacaaatgagatagattataggccccttcgcttcctcgttttccccacaaacaaatctctagactttatcatgccaggtacaatgccacttatagttacgaatggaaattgggcaacaccatctcttctccctagtgaaacaagtgctgttactgagccaggcttgtacgttgccattttgctttcctttcctccagccatcagtaacttcaagttcccagcagccacatccgcatggctctctgccaaatatccttgtttgatttcctgttatatatatacacccacacatgcctaattagtttgctactcaagcagtatagattctcgtggatctttgtaaaaagtaaaactcatcaacttacaatggagaattgttttagaagaatcagtagctagcgttcttaacttatatggagatgtgacgccttcctttaggattgcaatttgcatgtatccactgtattttatttcaacaattaggcgtatttcttattttgaggaaaatgtcagtaaatatgagggcatatattatatgatattttcttgtttgcttgatgtcaacaaaacagggggaagaagactttaaaattttggctaccacaagaaatggcctggtactcttgctttagctgactttataatactatgctgtaagagtataatttcactatcaaatggatttgggatttctacttattaatgccatcatgaaattatcattaaaacatcttaagttagcttcaagtaaactcatttagacaagttagtttcgcttatcacgttgctcaagtgactcattatcaaaatttgctcatcatgtaaggaaagtttatcttatatgtttcttctcttttattccttctaaaattcaaatttaggtagcctttttttcttttaatcctgacagcaaaaattttgatttatggaaaataaaccctagcaaagcaaagaaacactaaatatattataagacttcagttcagaacttactggaatatttgtaatatctccaattgcaaatatattcttccaacccctgactcttaagtactcatctacctccaacctcccattagcatccaagttgttcttcagaacagtgtccttaagccaagctgaacccagtggtatcccagtgcaaaggaaatggcaatctgctttgatagtttctccagctgaagtatgatatgttttggtacaattaccatctgaccctgtaatagaatttaaatcaaccctttgctccagtttaacttcaacattctttgacctcaaccattttagtgtcttgttagcagcttttggtccgataaattccattaaccttgatccatcatgcaccagagtaaccttcttttctgggaaatcagctgcaatttctcctgcaagttcaacaccagtgggacctcctccaacaatcaaaatggaatgagccgacttaatcttttcatttcctgctaatgcaagtaaattattttcttgggcagaaacaacatatccatagaatattcttcaagcataatatgatcttctcaaaaagaaaagaaaaatcatgaaatgagttttgcataaagagttcatgaaaatttatttcattaaaactcaattggtcacaaaaattgtgatgttcttgttttctagaaattttcttctccctcgctttttcttaattctctaaacaaaatccaatagagttatacagtgtgaatcaataggtattccacctgcatgtgttctgcaataatagaggctctaaagaatcccattcctttgggactttgggttacaaaccaacacaccaaaacatgtaaccaaatgaccagtgccataaataaataacggatacggacttgtaacctgtcaattaacctatagactagtgttttgagattaagggagatggaagaaaaacttgagtgtgtgtgcagagttttacctgcttggtattcagtaagtctctctgtcctagttttggggacagaatcggcatggccagttgcaatgacaagatagtcatagggaattacttgaccatctgcagtcagtacatctgcgtcagtgacgtccactgcagaagaagcaataatgcggccattggtgaagtaatctctatgatttatgactgatctctcagcaaatgatggctccaccaatgctctcaagtttgcccatgtaatctcgaagtactccttcctggattcaatattatattaagttaggaccattaacgataaaaagagaatttgatgaaagaaaataagtagaggaaattgatcccaaaacttatcggatttgtttaacctcaaacaacataagaacagcaaaaacactaattgcagagacgaagagcttatagagatttttgcaattggctaaagtaatgtattgcacttttctttttctttttgaattatcatcatcggatcttgaatattttatcaattacaagacggttggttatttttatagtactggtaagaagagcttttcatagaaatcaataatcagatgtacacagtatcaaacatgtcacggttgaccatgcaaataaaaacagaaaacttatgttgcaatagaaagtattaggatataaaagaattaagaaaagaaaaacagaaagaaagaagaagaaaaggcttacgggtcaacgagggtgagatgagcatcgaattgaaggtttttggcaatgagggaacctgcgataccccctcctattactaccactctcctctttcctcctcctcctgaacccgattccatttttcctcttctcaacgttccaaccaaagccttgtctgcttttgtcctttattactggctccattcaacacgccagccagccagcatactttctttctgtctttgcttttctcattcgtttattttatttcacctgatcattcaacacgcaacatgagttgacaaagaatgtgtgattatcttatctgaactcatgataagcccttttaggttagatacaaatagaaaggcaagtgccattcagcccaaaggctcttgtcagttttggctccactcaacttaagcccacctatttttttatttaccacattcccggttacttgtttttcagtttatgtcatgaatagttataaaatatggtcaaatcaaaatctcatatcatttggtaacttaatatttgtatgtcataacatattagttgccaaactaactactataacctgatcaataaacaggctttgcaaattacaatctatagttcttcttttccttttccttttctttaaaaaaaataaaaattgctcctgccctttttgtgaatgtatagcataaattataatttatggagtctaaagctagtaatgtgatccttaattattttagattaaaagaaaattttaagtcattgttaatgtgtaggcatgtgcaaatccagggagttgcaaactagcaatagcttgcggtagaggaaatgaatcaggaccaccacgtttctgatatcgcaccaaatctggtgtccctggcgctaggaacatggctttcaagacaatgaacacttgcttctatatcccttctctaatcaaactccattcgttttctcatctttatattcttgtcaaatattccattttaaccttaacccttctgtgaaatttgggacatccatgaccaactttattatacacaagatatatagtggataattccacttacaataagctctcttcttttctatttcattttctaatttttattcttttgcataaatttctagtatgacccattatccgaaagacaatccaacatatatctctctttttccacatcctattatatcacccatatattaataacacatgtaaattactatgttagtagtcatacctcaatattaaaatgatcgatatatattatatttcttgagacagagcatatgctatatgcttataaggtgtctattggtaagttatttgttttcttttttcaaaaaaaaaatgtcaattgaaaaggcaatgtttggttagtcaacagacaaacaattcccattgtctagcaagagaaaaaggatagcttttatattaaacatgtagaataatagatacattcttcttcttttacaaaaaattgataaaacttctgttggactttttggatttgtgcaagagtgttgtgtgttgtaaataatcggaaaatgtatctttaattattaaataactttttttctatcttgatagattttgaatatagaatccacattataaaaaagtaaaaagaatgaaatactaatttacaattctattaattttttcaataaaattatattcatattcattcaatgaacgaacgaagaaaagaaaaatattaaatatttgtttttgttttatctcttactcattaatatcgtatctaatatctttattaaattatattttacttttaaaatatcaaaatttgttttataaagatattagctaacatattaagtaaacaagagatagacaaaagaaagtaagtgaactgtttaatattactggtgaaaaaataaattcaatgcagttttgcagggaatggcctcggtttcttgggagagtagcgccattattgataaaatcctttcacatgtgtaacggttttgatttcttttatggtttttgtaaggattagatttaattattaaaaaactttaatagaatggaaattctaaaatttaacttttacttgtccttaattagacttatataattctattaatatataatattttttattttaaattaaattaataaaattataataataaattttcgtgttactcattctcttcacattttgatatatgtatgatatgaatatggacagttgaagccaagccaagccaccttattctaccttgcatagcgaatcatgataatacactaatcattgcataaatcggtcaactcatctttgtgcagcttcaagccttctctttcatacactacattacattgcacatgtatgaattgactgcgattttgtgcaattatctcttttttttttttcgtgtttatatgagaaattttggaaaagaaaaaaaaaaatcttcatgcaaagtaacaaattactcaatctgcagctactaatgattaataaagatagttaatattattaaggaaaataataataaacctatggtaaggctaaggtgctagattttcttgcaagattgaggcatttttggtaactgagtttagcaacaatctcttattacctgcacagttaatgatattactcaattatttttgctagtcttttttaattttcataaaaaaagaataaaataaaagccatgtgcactcgatgaatgagtgataactaataattgtcaaaaccttcccttgtggggtggggccttgaagggcagatacaagccatgtgcgaataatttcatgtcaaccttaatacagtcttagattagtcggttgaaccaaatgttaagccatgtttgcaatttattttatacatcattatacacatttcccgcttaaaaaataaaaacaacgacagggctcatgcagtcatgtgtacttcaaaattaaaattaggtttcagttctaaacagatttatttttttgtacttgaatggaaatggtgcccgactgcgtgataataattagtaattagttatgattaatgaggtgcgttaaattaagacccaaaagaagggtctcaacaaaaagcagggaggttgtagatagagagcagctgccagctggtgtcggctaaatggagagagggtgtgttcagttcagttgtactatatttgtagactagtagatttgctcttttcagatagttttgagttttgagtctcgagtcctggggctgggttaaccagtatagtagtacgatctgtgctaatactgtactaatacatattaatcaatgctgtgaagaaaaagttgcagtagtattttattttattttattttttatctaaattttcctctgtcgtcctccttcccacatactgctctgtagggaaagagtgatagaaactggaaaagctaaagattgaaaaggaacaaaacacgacttcgtactcctgaaagaagtggatcacggattcgtctctcactttcttgactgcgccaaaaggaagaggatcaaatgattcgattctgacataagcttagctccctcagctcgtatgagctatgatagctttatgattattgctgctcaaatagaatgactagtggatctatgaggcggaggaggaggaggaggagaaggatattctgaatctttcacaatgcgcttttattagtttaggatttcgattttttccttttaaaattttggattgcagcggtcctttttattgatttcatcaagtcaaattggagaaagagtcttgtgatggagtctcgaatggatcagtatgagatcatggagcagatcggccgtggtgcctttggtgctgccattctcgtccaccacaagtctgagaagaagaagtacctctctttctatattttatatttatatacagttctccaaaggaacgcaattgctctttctgtgtcttttttttcttctttaattacattttcctttttcaatttgttagatatgttctgaagaagatccgtcttgcccgacaaactgagagatgcaggagatctgctcatcaagaagtatgtctaatctcctattttccttttatgttcatttttcttaatttcctcttcgtttctctcttttcttttttctatattattactattatttttggtaatgtagatggctcttattgctcgaattcaacacccttacattgtagaattcaaagaagcatgggttgagaaggtactattgcaaattatactacttcttacgtgtatattttgtattagaaactgaatcacaaccttttcagggctgctacgtttgtattgtcactggatattgtgaaggtggagacatgtgagtttccaactacttctacaaatatttttcttactagctttcatcatttacactatgaattctaattgctcttttacaacattcctctcagggctgaactaatgaaaaaatcaaatggtgtctatttccctgaggaggtaaaccttcttctatcttttccttttcctttttccatgtccatgaacttgagtttccgttgctgattattcttgaaaatctctcagaaactatgcaagtggtttacacaattactgttagctgttgaatatctgcatgccaattttgttctgcatcgtgacctcaaggtatgtgattaactcatttgattttgtctgctgcattttaacaagttctggactcaattaacttctctctccacagtgttccaacatcttccttaccaaagaccaggatgttcgtcttggtgagtttccctttactcccatttagttttcatttctttaggaatttggctaccgttttcattcatttattttatctttgtttctttttttgtcatatgtaggggattttggacttgcaaaaaccttaaaagcagatgacttggcgtcctcggtatatatgtctatgtgtatatatatatatatatgattttttggtttaattattttggatgtttgtttttatcctttgcctgttttatgcagacacaaaaactcatgtgctacatttccttttcttttttcctcttttgatatatgtgttccctctgcattacttctactttgtttggtaaaaattgtgttagttcgatatgaagtaggagaatatagaatatatattttgcatccgagcttcattcccaggaataggaaatccttacaaataagaccttacaaatgtatcagaaatgtcttaatattattacattctacttttcttggtaagtgcttccaaagtttatgctaacaaagttgtgttcttttgatgatcgttgtagctgttggagtatgaccaattaaactacaatgagaggatgattatttctctttgaagactttaatatctggttgaggaaatcgtatatatggttcactgatttttatcatttttggttcagaaatcaaattgcttgcataacagtgataataagtctttaagcaaaaagttaacaataaaatgtatcttgttaaggcttgccatataataaacaccagctaacaaaatatatctgatatttacatttgaagtataaatgtgcctctttacgaggttatttatccttgagaataagtgaatcaatgaatcttctgagagagataattacttgtatcatgaccatgcaattaattgttgttttgtacacttatccgcaggtggttggaactcccaattatatgtgccctgaactccttgcagatattccttatggcttcaaatcagacatttggtctttgggtatgtgcctcctatattattcctgtgaaacttatctctctcttcctctctctgtggctaaaatggtacatcattcatcaggatgctgtatgtatgagatggctgctcatcgtcctgctttcaaagcttttgtaagatttccaaatgttcatttcttgtaatgatttcttttttttatttgtgaaaacgtgtctaactattgcttcttgtccctacaatttatttatgtctaggtcatgatatctctcttgtgttaattagacaagagtgtataatttattagtattcaaccacagcatctagttgctattaacttatactgtgatgttacacattgggacatgagtgcatcattgtttattttcaatatattttattttaatcatacaattacatgatcaacagaatgcattcaatgccagtttactttcagtatattgaaataatgcttgcaaattgcaactggtaaaaggttactgtagtaattagcaaccgctttaagttaccaccgttttaggagtgcgttctataatgccggagttaatttcttcggcaataggtcatgatgaagtgtttaatgttaagcttctcataaggggttcctttttctggttagctctttctatttttactgatgagtttttgcaactttctttgattgatgcaggacatggcaggattgataagcaagataaatcgttcatcaattggccctttgccttcctgttattctccagccttgtaagtctccttatgctggtgtaaaactttttattttcaagtgttacaacactgtggattttgttagctttcttgatgctttacccattggcaaatccacattgctcccactgccccctaaaattttcatgtattctcctttgctccctgaactttgcccccacttaaaggacatgctctgcccctacaatttgttgctatatgtatatttttctctttttattatagaaagggaaaaaattgtccccactctgtatattgtggagttgccccgggctttacctggaaggtcacaagccaattgctgtttgtagcaatgtccatgccctattaggtgatggtaacaatgccagcactaatatgctgtgatataacctatgttttaaagaaaagcttccttggcttttattgctggaattatagatattcagtgatgtttattttttatcatatctatggttatgtagttattgttagtaggaattccacacaataggacaaattaaatgtctttttcttagttttttatatcaatagatatgccattcaacctaggtaataggaccttacagtgtatgatatagtggttatttcccagaatgtagctaacttcttagatcctgtttaaatcaacagtttttattgcccttttcttctgtccagttgtttggtatacttgtgcaacccatgagtaactattctgttacatgtatcatggaaaataagaatattctttccactaaatttctgtatgatccaacttgcatttgtaaggaccttcaaccatttcatttcatttcatatctccttagctgtttagtctgaaatccctgatatcaaaagaaaaccaacagatatattggggaaattaaaatgatgcatgtcttatatagttgacattgtttaacgctgttgattaacctgaggtatctcagggaaattggatagctaattcattaaatagggttttgttgctttcttcattcctaggcgttacctcagatatcaaggatctaccatcaaataactgtgtatcatttatagtttgtctttcatgcacaggaagacattgatcaaaggcatgctgagaaagaaccctgagcatcggcctagtgtaagtatctgtgctaaatatcagtatcagcttcagtaattcttgctagtaagatttcatattaactttctggatatactttgatcaggctcccgagatattaaagcatccttacctgcagccctatgttgatcaatatcgtctgtccttcattcccccaacgatttcccctgagaagcccatgtctaatagtcgtgattctcggaaaaatatggctgaaagccaaaacagcaatagttctggtagtgataaagatagtttactttcaagtgagagaaatttcccagcaatggtctcaaattgtgtgcataaagccactgatacagatttagcttctattggtgatgaagatgtcaatgaacagtccatgccaaatgaagaagaaaatggcccatctatatacattgttaaaatagacgaacatagggttgtgaaaacttatcatgatgaacatggatccaacgttgaatcaaaacaaccaaagaccattaaaagcattatgatggccttaaaagaagggaaaactagagaaaatggttctccaatgagaggcaaccgtatcaagcctggaggtttacaaagaagtaatactgaagcatctcccaaagttgttaaacccaatacccttattcctggtttgaagtgtaatacagatgcgccaaccattacaccatcaaaggtagcttttgattctgcgaaacgaattnnnnnnnnnnnnnnnnnnnnnnnnnnnnnnnnnnnnnnnnnnnnnnnnnnnnnnnnnnntaatcagaattttttttccattccttgtttcatacacatataaacatggtcacttaaattgcaagtgtaactttacagttgccaatgattgactctactccaaagagtaaaccaagatatgatggtattcctccatctggtccattaaaacatgttgatgatggacttgctgtaaagccaagacaaagaactcctccttccaatctggttaggcgatgttcatttcctggaagggtgaggcaagtggtaactgatgctccaaatggcatcaccaacactgtgaagtcaagtccaactgagacgaccgaagtacctgaaaatactcatcatgtgctcgatgttcaccatatacattattcgaaagaattcagagaagaatctcagaaggctgtagctggagcttccagaggaatgcaaacagatggcagtaattctgtctcatctttagtgtctgttcaagcatttgagctttgtgatgatgcaacaactccatttggtgacatggtagaacagacaattcatgaaggtgaggttgttacttgcactgggaaatcagaattagatccgagctgctcacttacttcacttttgcatcccaagttatctaaaaatgtatcaagggagaaccatggttatggttataaatctgcagttcattcggttgaaacatctgtggctgaccttgattttccaaagaatactacttccagtaatgggaaactgatttcaagtgcagctctggatctatcagttcccagttctgaagagacaccaatttgtaaagatgatacccttttaagtacgcctaacgttaggcctgatgctgtgcttcaatcaaatgcgacatctacatctactggtaatgacaagttcactgtaagagaacttttatcatctgttccagaaactgttccttccattgcctcaggaacatcaattacgcaaaagatttgtcatccagagaaaggaactactttgcaaaatccaacgattgagaaatcaactgcttcgcatctccctcctgcttttgacgatgtcatacatgttatacggcacagtagttttcgtgttgggagtgagcagccagtgatggaaagtgtcgagatgggagttcaaaatgtggatgttggaaagctattaaatgtagtaagagatgagttggagatcagaaacatgagtgctcctgtgactctcaaatcctcaagttgctcagaagctgtgagtttgaaatcaaatatttcagattattctttgaagtcaaatttttcggatcattctggcactaaggaagtagatacgacaaatatgaatccttctgtttcaacatcagatacttcggagcaaagaaatatcaattcccttattacagaagaggaagcaccggcaaaggaaacattagatgttaagtcctttaggcagagggcagaggcacttgaagggcttctcgaattgtcggctgaattgctagagcaaagcagattggaagagcttgctgtcgtgttgaaaccttttggcaaagataaggtctccccaagggagacagctatctggttagcaaagagtctcaagggaatgatgatcgaggagagtggacggagttcatgaatcatgatatatccatggtaagcgagctcttattgtgtatcaatatctgtctagataatttagcatttttttttttccatttcatatgtgatttgtcctcgttcaagctccattgaatttttgaagggaacagacaggcattgtcttctttgtccttctgtattttttctttttctttttccttgtccacgttgtttttgtacatagggaccatacgaaattatttttcccctacccaaatatatggacatgctgtgataatcggtgaatgtcaggttttgattttgctgcatccattattgattattgaggcatcattatgcaaaaatttctgcactgtaatatttgcagaaactcaaaaactgttagaatatccgttcagttcagttaaactggattatattttttaaactagaaccaaatgaaaaatttggcttataaaaattttaaaatcgtaatcaaccatatgaattaacctaaatcatggtttaaattgaatttgatcgaattcagtttgattcatttgattaatttttatgcagtcttattattaggtacgtaaatacatgaactcgaatcgaaaagattaattatagaaatagagtttttggtgagtgaggaaaaaggaaaaatgagagaaaagaaagtgataggttattgaaaaagataggttaaacgttaagatagggctattaattgaatcgagctgagccgaatatcaatacgtttaggtttggtttgtttaaatttggaagaggcttgagctttatatgagctcaactcgagtctttatagtggaattcgagattgtcttgtttgaaaataattaggcccatgagtagcttgagctcggttaaatggatagctcgagttggtctcgaatttaattcattaaggggttgcgtaataagaaaaagtcgagtttcgttaagcctatattgagaacaagcttgttaagcacagttgagctcgagcgcaagctagttagagtttaagattttagggcgtagagtttaggatttataaggatattggggttatataaaactacaattattacaaactgagcaacttctgacagttgataatttctactaggtgatagtaaatatttatgatcaacctgattcttacatatactaatatataaaaatggtaggttgatgcatgcagacctagagttgtttgtttaaaagaaagaaagtagataaataattcaaaaattgaagaatgataaaaatattggtttagtttatgtaaaaaactaattcaattaattggaacaaaaaatggagaaaaaaaaaattgtataacacatactaattagaggaataaaaaaactaaagcaactaacatttagaaatatgaaattttgcaattagattttgtttcatttatcatatttatcctttagttcagtagttcagttttaatttaggtttttgaaaattcaataaaaataaaataagtaaaataaggagtttttatgtgctagagtcttgataataaatatcttttttaaacccaactgtcaagaaaatgaaaggggaaacatatgccagnnntctgaaatgacttatgcgtttacttggaccccgggtctttcattttttttcttttcttatgacaaaaaataaagaagtatacataggagcagatgaaagagagcttacacagtaaagcacggccagaagtttgacgttccaaccaagcatccactcatgaggatctcttactaaagcaatggcaatgacgaatgactgaactgagtatgagtaatttgttatttaaatataaaatttacatattttacttaattataatagttatagaattatatgtttaaagttagtagaataaaattatgtattttttaaatggactccaaacttgaactatttagattgtttcaccccctactcttgaactgttcagattgtttcaatcctactattcacattaccttcatgcatttaaaactaaattctcatagttatatttcgggaagaacaaaccctaattaataagaaaaaaaagtatactaatatcaattcactaaaaaatgaattgaatcatgatatctctaagtttgatgatcatgctactggtggtagatggaagacaaggttggcccgagtctgcaccttatgatgccattcatgttgggctgttccagtagtagattttgatcttgggtgtggggttccagtaggaacaaaatatgactgtgcatccttttcttcttgattttctcactgaagagtagctaatattcccaactgaaagatgagctcagcgaatttgccacagaaggaggcaaatttgctgaaagggcaggcgcagtattagctgcaagattcaatggagatggcactaatggattatgggatataggacaaagagtcatcatatataatacagcaagcagtccaaattcaagtaagcctttaaacggcctaaatacctaactacaagataaacataagcccaactttgaagtcatgggtttcagcaatactatttgtcagttgtataacataaatcagtaatgaggtaaccatcctccaccatacatacctttcggtgcggtcactaaagaattgcttatacactaacagttgcttatatacggcttactaaaagactgactttcattcattaggccaacgtgaaattaagaaagagagatgttcctaaggtggcatgcaagcaaattgggcatgctaagaaaaaatgagagatgtttgcaattagtagcacaagaaagctgccacctaccctatctctaaaggggcccgtcacttcgttcataccttcttggctaaggcttcc

SEQ ID NO: 2 - DNA, 427 bp, Ricinus communis
  misc_feature: Determinate castor deletion flanking region
  misc_feature (178)..(179): breakpoint flanking nucleotides
  misc_feature (419)..(419): n is a, c, g, or t
ttcattcctgagcactgtactggtatttgaaccagtaggttctaaaggaccatccaacttactgattccactaacaccaggggaagattttgacctgcgacacataagaaactcattaacacaacaaacttgttcctttttttttcccatcataacataaaaaatagaacaatttcaaccaatgaatttacaaaataaatagcattttttcaaaaaatgacattaatgtgacaatcatttactgaaaactaaaaataaaaataaaaaatatatttttaaatattttttatacttttttctttactcatttttaaaatttttaaaaatgtaatctatattattaatataattacatttttttagatagtttgtatttttagttaattaaaaattaaattattgaaacagtgacatgcctnaatcacta

SEQ ID NO: 3 - DNA, 2182 bp, Ricinus communis
  misc_feature (93)..(93): n is a, c, g, or t
tgcttaaagacaaaacaaaagaacattctcccaacaaggcagaagtttcaaaagaagttacaacacacactaataatgtatttcttgacctcnaacaaaacctttcctaaacttttcttctttttcttaaaggtaaccccaccattccatggattttagtggcttgaaaaatagcttaatgaacactataaatatgggggggttccaccttcaatatgtcttcaagctagacacatttcaagacagcaaaaggaaaccaatcaagaaacttgttactctctctgtttctttctctctctttcatctttatttaatccctcctttgtttttccttttcctgaactcatggccaagacatcagatcctcttgtggttggaagggttattggagatgtaattgattatttcacaccaactgtgaaaatgacagttacttataactccaacaagcaggtttataatgggcatgagcttttcccttctgctgttactagtaaacctaaggttgaggtccaaggaggtgacatgaggtcttttttcactctggtaaatatatatatatatacattctcatcaaaatgaatttccacaatccctaatccattagacccaaatcttttttcccttgattgatgcttttctttttctttcaccactttcatatgtaaaattgtaggtgatgacagacccagatgtgcctggtcctagtgatccatacctgagggagcacttgcactggtatttgatattctacagaatacccttaaatcaaggaggaatttgttttcataattgagaaaagaaataaatgaaagaaaggaaagaagtccttttgttttaagaagaaagaaaaaataaggatgaatgtagctagctagtacaaaaatggaaaaaagaaatgatataaacatgtccagattttcacataaattttcagtacaaagtgtagaaacaaaaatagtatgaaagtacatcactgtaaaacatgcatatatagcaaaacatgtatactcatggcttgtgaacttttgatttgaccatcttacaggatagtgacagacatcccaggaacaacagatgctacatttggtaagctttatgaatatgtaagagagctagaaaatgcaaaatataacataaaatgtgttaagaaacataaagtaatttgtgggtttcttcatcttcttcttttttctgttttctcaacaggaagagaaatggtgagctatgaaatgccaaggccaaacataggaatacacaggtttgtgttcctcttgttcaagcaacaaagaaggcaaacagtaaaaccaccaacatcaagggataggtttaattcaagaaaattcgcagaagaaaatgaacttggcctgcctgttgcagctgtcttctttaatgctcaaagagaaacagctgcaagaagacgctaatgaagaagagagaagacataaacaaataaataaaaaccagtggcagtggtactacgtactcttggatcggcatcaactgatattgtcattattatcattagtattagtgttagtatattatcagtgctgtttaaagtattatatatatgatcaaatgtagatatagtagcactgtgtttgaatcttaatcagtgcttaaaaaaagccaaaaaaaaaaaaaaaaaattaatgggaaccttgttttagctagaataagccgggtggagatctttatatgtatctatgtactgatgttgctgctttgcgagcaggaaatttatgttctaagtaatgtagaatctcttattacataaacccttgtcttcttcttttctgagaaattatcacaaggttaatctatggattatatacaatccttgtaacagtaagttttctgttcatatactacaggaaagaaaaaagaaaatatgaagagataataaagaaaaagacagggaaacaatgggtacttattagtatttcactatgtatactagtgactttccatcatattatcttacctaaagttgaaaaatgaatatctacagccggtccaattttatatatgattaaatggcttgtacggactgcgcagattttgtggatcttttgacagtactatttatatagataatgaacagataaatgcagcgttcggaaaactgaatcgctcattcaaatggctaaaggattttagggtgaggttcagactttga

SEQ ID NO: 4 - DNA, 516 bp, Ricinus communis
atggccaagacatcagatcctggaagggttattggagatgtaattgattatttcacaccaactgtgaaaatgacagttacttataactccaacaagcaggtttataatgggcatgagcttttcccttctgctgttactagtaaacctaaggttgaggtccaaggaggtgacatgaggtcttttttcactctggtagtgatgacagacccagatgtgcctggtcctagtgatccatacctgagggagcacttgcactggatagtgacagacatcccaggaacaacagatgctacatttggtaaggaaatggtgagctatgaaatgccaaggccaaacataggaatacacaggtttgtgttcctcttgttcaagcaacaaagaaggcaaacagtaaaaccaccaacatcaagggataggtttaattcaagaaaattcgcagaagaaaatgaacttggcctgcctgttgcagctgtcttctttaatgctcaaagagaaacagctgcaagaagacgctaa

SEQ ID NO: 5 - protein, 171 aa, Ricinus communis
MAKTSDPGRVIGDVIDYFTPTVKMTVTYNSNKQVYNGHELFPSAVTSKPKVEVQGGDMRSFFTLVVMTDPDVPGPSDPYLREHLHWIVTDIPGTTDATFGKEMVSYEMPRPNIGIHRFVFLLFKQQRRQTVKPPTSRDRFNSRKFAEENELGLPVAAVFFNAQRETAARRR

SEQ ID NO: 6 - DNA, 20 bp, Artificial sequence
  Single strand DNA oligonucleotide
tactcccacaaggccacaac

SEQ ID NO: 7 - DNA, 22 bp, Artificial sequence
  Single strand DNA oligonucleotide
tggagttggcttgtttcttgag

SEQ ID NO: 8 - DNA, 20 bp, Artificial sequence
  Single strand DNA oligonucleotide
actcgatggcttgctctttg

SEQ ID NO: 9 - DNA, 20 bp, Artificial sequence
  Single strand DNA oligonucleotide
ttcacatgcgctcttctgtc

SEQ ID NO: 10 - DNA, 22 bp, Artificial sequence
  Single strand DNA oligonucleotide
agtgattaaggcatgtcactgt

SEQ ID NO: 11 - DNA, 27 bp, Artificial sequence
  Single strand DNA oligonucleotide
accaatgaatttgcaaaataaatagca

SEQ ID NO: 12 - DNA, 22 bp, Artificial sequence
  Single strand DNA oligonucleotide
aatagtgggctcgggttttctc

SEQ ID NO: 13 - DNA, 20 bp, Artificial sequence
  Single strand DNA oligonucleotide
tcttttctccgccgcttttc

SEQ ID NO: 14 - DNA, 22 bp, Artificial sequence
  Single strand DNA oligonucleotide
tggaaaagtcaaatgcctcctg

SEQ ID NO: 15 - DNA, 21 bp, Artificial sequence
  Single strand DNA oligonucleotide
aatcgacaggagacacgaagc

SEQ ID NO: 16 - DNA, 20 bp, Artificial sequence
  Single strand DNA oligonucleotide
tctctgcgtgaacaattgcg

SEQ ID NO: 17 - DNA, 20 bp, Artificial sequence
  Single strand DNA oligonucleotide
tgaaggcgagttttgcgttg

SEQ ID NO: 18 - DNA, 20 bp, Artificial sequence
  Single strand DNA oligonucleotide
cctgaagagagccaaccaac

SEQ ID NO: 19 - DNA, 20 bp, Artificial sequence
  Single strand DNA oligonucleotide
gcaacagggctacaatttgc

SEQ ID NO: 20 - DNA, 23 bp, Artificial sequence
  Single strand DNA oligonucleotide
tcccataagagaggcttttcttg

SEQ ID NO: 21 - DNA, 23 bp, Artificial sequence
  Single strand DNA oligonucleotide
tggaagagtcaactttggaatcc

SEQ ID NO: 22 - DNA, 22 bp, Artificial sequence
  Single strand DNA oligonucleotide
tccaagatccgtacagtccatg

SEQ ID NO: 23 - DNA, 21 bp, Artificial sequence
  Single strand DNA oligonucleotide
aatcagtagcccggttgatgg

SEQ ID NO: 24 - DNA, 20 bp, Artificial sequence
  Single strand DNA oligonucleotide
aggccgaattgcacactttc

SEQ ID NO: 25 - DNA, 20 bp, Artificial sequence
  Single strand DNA oligonucleotide
tggcagaatgtccaacaacc

SEQ ID NO: 26 - DNA, 20 bp, Artificial sequence
  Single strand DNA oligonucleotide
aaggccatagcactcgaaac

SEQ ID NO: 27 - DNA, 22 bp, Artificial sequence
  Single strand DNA oligonucleotide
ggaaatgagtttgagccatggg

SEQ ID NO: 28 - DNA, 23 bp, Artificial sequence
  Single strand DNA oligonucleotide
ggactagcctatggtcattttcc

SEQ ID NO: 29 - DNA, 20 bp, Artificial sequence
  Single strand DNA oligonucleotide
atagcatgggccaaaatggg

SEQ ID NO: 30 - DNA, 20 bp, Artificial sequence
  Single strand DNA oligonucleotide
atgcctggtgctgtaaatgg

SEQ ID NO: 31 - DNA, 20 bp, Artificial sequence
  Single strand DNA oligonucleotide
tgcaaaaactccctgtctcc

SEQ ID NO: 32 - DNA, 20 bp, Artificial sequence
  Single strand DNA oligonucleotide
cccccaacttgctttcttcc

SEQ ID NO: 33 - DNA, 22 bp, Artificial sequence
  Single strand DNA oligonucleotide
tgaggtctcttccattccatcc

SEQ ID NO: 34 - DNA, 22 bp, Artificial sequence
  Single strand DNA oligonucleotide
gcagagaagatcatggaactcg

SEQ ID NO: 35 - DNA, 21 bp, Artificial sequence
  Single strand DNA oligonucleotide
gccatctctccctgcattttc

SEQ ID NO: 36 - DNA, 21 bp, Artificial sequence
  Single strand DNA oligonucleotide
tctgtgggtctttggtttgag

SEQ ID NO: 37 - DNA, 21 bp, Artificial sequence
  Single strand DNA oligonucleotide
aaatcgaggatgacccacacc

SEQ ID NO: 38 - DNA, 21 bp, Artificial sequence
  Single strand DNA oligonucleotide
tgcatctggctcaagttttgg

SEQ ID NO: 39 - DNA, 20 bp, Artificial sequence
  Single strand DNA oligonucleotide
aaaaggccgtcgaatgaagc

SEQ ID NO: 40 - DNA, 23 bp, Artificial sequence
  Single strand DNA oligonucleotide
caacctggagaatttgacagttg

SEQ ID NO: 41 - DNA, 20 bp, Artificial sequence
  Single strand DNA oligonucleotide
aagccagcagagcaaatgag

SEQ ID NO: 42 - DNA, 21 bp, Artificial sequence
  Single strand DNA oligonucleotide
ggcaatggcactttcaattgc

SEQ ID NO: 43 - DNA, 20 bp, Artificial sequence
  Single strand DNA oligonucleotide
aaaaggtggtgggacttgtg

SEQ ID NO: 44 - DNA, 20 bp, Artificial sequence
  Single strand DNA oligonucleotide
accgcaactcctcattttcc

SEQ ID NO: 45 - DNA, 20 bp, Artificial sequence
  Single strand DNA oligonucleotide
atcgggtctttcaacagcac

SEQ ID NO: 46 - DNA, 20 bp, Artificial sequence
  Single strand DNA oligonucleotide
aatgatgacactgcgtggtc

SEQ ID NO: 47 - DNA, 20 bp, Artificial sequence
  Single strand DNA oligonucleotide
aaaccccatcgaaacagtgc

SEQ ID NO: 48 - DNA, 20 bp, Artificial sequence
  Single strand DNA oligonucleotide
tttttcacatcgcgcaccag

SEQ ID NO: 49 - DNA, 20 bp, Artificial sequence
  Single strand DNA oligonucleotide
tcaagcgcagatcaaacctg

SEQ ID NO: 50 - DNA, 20 bp, Artificial sequence
  Single strand DNA oligonucleotide
aaaccttgcctcaagacagc

SEQ ID NO: 51 - DNA, 22 bp, Artificial sequence
  Single strand DNA oligonucleotide
tcaaaccgaacagtacctccac

SEQ ID NO: 52 - DNA, 20 bp, Artificial sequence
  Single strand DNA oligonucleotide
aagctgcgatcttgcgatac

SEQ ID NO: 53 - DNA, 23 bp, Artificial sequence
  Single strand DNA oligonucleotide
gcagttataaacaggttctgagc

SEQ ID NO: 54 - DNA, 22 bp, Artificial sequence
  Single strand DNA oligonucleotide
cctttgttcttggccgtgtatc

SEQ ID NO: 55 - DNA, 20 bp, Artificial sequence
  Single strand DNA oligonucleotide
aacaatggccgagtcaacag

SEQ ID NO: 56 - DNA, 20 bp, Artificial sequence
  Single strand DNA oligonucleotide
tcgcaggtcaaaatcttccc

SEQ ID NO: 57 - DNA, 22 bp, Artificial sequence
  Single strand DNA oligonucleotide
tcattcctgagcactgtactgg

SEQ ID NO: 58 - DNA, 22 bp, Artificial sequence
  Single strand DNA oligonucleotide
accagtacagtgctcaggaatg

SEQ ID NO: 59 - DNA, 21 bp, Artificial sequence
  Single strand DNA oligonucleotide
ccttttgtcacagccttctgc

SEQ ID NO: 60 - DNA, 22 bp, Artificial sequence
  Single strand DNA oligonucleotide
gaaagtgaggaatcaggtgctg

SEQ ID NO: 61 - DNA, 20 bp, Artificial sequence
  Single strand DNA oligonucleotide
ttagagcaacctcgccactg

SEQ ID NO: 62 - DNA, 21 bp, Artificial sequence
  Single strand DNA oligonucleotide
caaaagttcacaagccatgag

SEQ ID NO: 63 - DNA, 20 bp, Artificial sequence
  Single strand DNA oligonucleotide
ttctcccaacaaggcagaag

SEQ ID NO: 64 - DNA, 26 bp, Artificial sequence
  Single strand DNA oligonucleotide
cagtaaatgattgtcacattaatgtc

SEQ ID NO: 65 - DNA, 20 bp, Artificial sequence
  Single strand DNA oligonucleotide
accaggggaagattttgacc

SEQ ID NO: 66 - DNA, 21 bp, Artificial sequence
  Single strand DNA oligonucleotide
tacgatggatcctctgtcctg

SEQ ID NO: 67 - DNA, 2701 bp, Ricinus communis
atgggaaagagagataagaaacagaggcatcataatcaacacagaagcagagtagcttcttactacaacacagaacaagaagatgatggttatagctattcacagtcttccttacctaatgaagactcagacgcagaacctgatgatgttgaagaagaagaagaagaagaagaagagaaagaggacactagtgatgcaaaagcatctaatgacgttccttcaaagtttcttctttaccaacaatctgtacaggtatttacccatgtatcgaaatattatgtgatcacgttgcttggttgctgagaaagattttatttttcctttttcttgtattcaatagtttgctagactagaaattgaggtagaaaaaaacgagcacccatctgccaatgttggttcttgtgctgctttggattgataaaaagatgtttggtcgtaatttagaaatcaagggctgagcttttgttgttaaaactgttttagttttctgtatctatagataaagtttgtatctttttttataataattgtaatgggtttagtggattcttaatgaattgcagtcgcccaaaggagatataagctatttgcaaaagttctttttactgtatgttggtgggaggttgcctcttcatttccaggaagatttctgcgggactgctcttttaaggtaaattactatctttctctcttttatctctctccctagtagaaggaatttagttgtttcagtcatggccactttatatttgcagctggtccaaatacctaaaacatgggatcccattttaatagattctttcaagcttctacctagttattcttaggaagcaaataattggtgaacacagaagggtagctgagacctgctgctttagtttgaggcttttaagtattgatgtaagagctgtctttaaggagccatggcttgcttagctaaagaacgattatatactaatacttatacatctatgtttatgacagtacagaatggctacgtagtgactcaagacggactgctgtaggagtggatttagaccttgaggcactaaattggtgcatggcgaacaatgtaaataaaattggggctgatggatattccagaatatccctctttcatggtaatgtcttgcaaccttctgatgctgaattagtcaggtttgagccccaagatctgataagtaacatcaaattgggagagcagggagacaattctgagaatactgcactggaatctgctctccaagtgggttcatcagcttctgttagtgataagtacttgaaaagaaactttcagttaccagcaagagacattgtgtgtgcctttaactacagctgctgttgtctccataaacgagcagatctggttttatatttcaaacatgttcttgatgccttgtccaaaaagggtggtttatttgtgatggatttatatggtggaacatcatcagaaggcaagctaaggcttcagagaagatttccaaattttacggtatagtatttctcttctcgataccatgacagattacagtcttagtgggaggttcacatgtacatatttggcatgcatcactttctttgctggcagtttcgcatttagaggacataaaaactctcaagcagcaaatctatgaaaacctatgctataacttctcttattaattgaagcagacagcagacatatgaatacaaaggtactttacatacatataactatgattttatggaaagcattttgcttgtctttttctttgttgttgtttttgaaaattcaatgcatgatttccacagctaatggttttcttataattatgcagtataaattggaaaagtcaaatgcctcctgtatctataaatgaatccccgatagttatatccgtaagcacagattttctgtcaaagttgatcttatttgctgcatgtatcatgaagttaaatggtcaataccctcggcttcgtgtctcctgtcgattgattttttcttttttaatcttttatgatttctgttcaatatgtgctttaggatatagtaggtgaattacagaaacaaactcacatggcataagttactatatacgaagaaaagaaattaaaaatattgtttgctcttgttgctgaattgcattaaatgtgattcaaaggtgcaaatatatctcgcatctttcctgacacggttctagtgcagaactaaatatatgcattgctgatgcacagacaattatgtcttcaaggtatagagttatttctttgctatttaacttttcataaaattcacagtatatctgggagcaagctgaatttaacataattgagcgcaaaacaaggatcagcctccactttcatcttcagaagcagcagaagaagcttcgccatgcattttcatacagctggaggctgtaagtcgtgtgctttcccaataaaatttctgcccagccagtttgaatattggcaacaccgaattttggtatgacaaactctgataatgagtgttgatctgtgcaggtggtcattgccagagatcagagactgcttagaagaggctggatttaaatccattcacttctggcttcggaggatgccagacagcaaagacaacaggagcgtagagggattcgggttcgggcgagacataaagtacgaggaggtcaaaacttttgaacaagaagattcttggaatgcatacattgtagctgttgcatag

SEQ ID NO: 68 - DNA, 1097 bp, Ricinus communis
ctttcttttatgtgggattgctttccctgactccatttccctcatacttttcttcccaaggattcttttccctttcctttcctttcctttccccctcttttatatttctctctctcctcctcagcaacaagatcaaactctacaatcacaaagttgcaactagaaaaataaaatcatttcaggtaagcaaagaaagaaagaaaaaataaaactatatgctgttttttttttttaattctttttctctcatctaatcattttacgaatttggtgttttgtaggaattgatttttccgtagatttgaaatggcggaagagcacagatgccaagcacagcgtctctgcgtgaacaattgcggatttttcggtagtccggccacgcaaaacctttgttcaaaatgtcaccgtgatctccaactcaaagaacagcaatcttccaacgcaaaactcgccttcagccaaaccctaagcgcatcatcgtcgtcatcgtcgtcatcgtcgtcgtcgccgtcagcggcttctgtttctatttctatttcatctcctccgatcgttgacctaccggaggtcagcagcaaagctgaggtggtggtagaggataaggaggagacagcggcggagacggtggtgcggccgaataggtgcttgacgtgcaggaagcgcgtggggctcacggggttcaagtgcaggtgtgagatggtgttttgtgggacccataggtacccggagcaacacggctgtacttttgattttaaagctatgggcaaaaagcagattgctaaagccaatcctgttgtgaaggcagagaaattggagaagatatgagttccttttatttgaaaaaactaaacaagaaaatcaaaaagttggtttcttcgtgtgatttggaattttaggatttggcttatggaatgaaaaatctgatgaatgttcccggccgccactggccggcctcgccggggatggtggtggtggtggtgggttgttaatggatgttattgttgttgttgggttggtggtagttgggtggggtggggagtattattatgtggtgtatgtaaattcaatgataattttaattggctcttccttttttt

SEQ ID NO: 69 - DNA, 1305 bp, Ricinus communis
atgccaaaagtcattgaatttgaagatggatctgatacagatatctccaagatccgtacagtccatgttcaatggttgtggtggtgggcagatttagcaatacccatcaaccgggctactgatttcatttcaccaatgaaaaggtcagtccgtccattttttagcattctgttattgattgtgtttgctattactcttacttgccggatcttaatccggaaaggtgctttctttagctcaattgaacttgaagccaacgtaatagtccacccaccactcccagttttcaactctacattgcttaaatatgcagctattgatattggtgaagctaaatctaagcaagaaatagaacaattattagaaggtaatttttctagtcaagggagatataggacttttgctactcggagaaggttcaataatcatgatatcagagctagttcatccagaggtatacctgtaatatttaggtcccctcagttttataggtactggttagagtttaggagggtcttacaggattggtcaagaaccaagaggtatcaacctgatataatgaatgaattgatacagcttgtaaagattcccattgagagacgaaagggattgatgggttcaaacaagaagtacggttcttgtgctatagtgggaaatagtgggattttgttgcaaaaagattatggagagctgattgatagtcatgagatggtatttcgactgaacaatgcaaggactgagaggtttgagcaacatgttgggtctaaaactaatgtttcctttgtaaatagcaacatattgcatctttgtgccaggagggtaggatgtttttgtcatccatatggagctgatgttcccatggttatgtatatctgtcagcctgtgcatatgctggactatactatttgcaatacttcgcacaaggcgcctctcattgtcactgatccgcggttcgatgtgttgtgcacaagaattgtgaagtattactccttgaagcggtttgctgacgagacagagaagtcactggatgaatggagctctacgcatgatggttccatgtttcattactcttctggtttccaagctgtgatgctagcggtggggacttgtgacaaagttagcatcttcggctttgggaaatcagcacaggctaagcatcattaccatactaatcaaaagagtgagcttcggttgcatgattatgaagcggaatatgacttctatcatgatttggtgagcaatccacagttaataccattcatttcggacaggttcaagtttcctcctgtggtaatttaccaatga

SEQ ID NO: 70 - DNA, 3987 bp, Ricinus communis
atgaaggttagttcttgttcatttccttttaattatttgattaatttcttgttattttcaatgttctgtcaattcgtttgcacgttttaagctcttccctgttactagtttattgggtttgggcatgttctctgatcattagtttttacatggaaaattagaaggtccatgaaacaaggtctcaaacacatggaccagcggctgatgaaggcaaagtaatgacaagaaagcagaaggcagagaacaagggacacgaaggagaacagtctccaaagaaggccaagaacgaaaatgattccagtcatgctaatgagaaaactaagactgacatttctaaagagtttgaggagttctctagagcaataagagagcatctctctgtttctcaaatgcgagaaatactagagatgaatgatcaagattcttccggctctgatggggctgttatcaccaaatggttaatcataaataccaagttaattcaaatatatctcatgtgtcttgactagttatagttttaagtgatagtttttggatgtcttttcttgaacagccaagatttattgttgcttgggccacttgggaaatgtccattgtgtgactgcactttggaatttgatggcaaaaggtattcttgcaacgggttttacagtgagtggtctagttgcactttcaagacaagaagtccaccaagaaaagaggagccactcaaattccctgattctgttctcaagtcccccattgcagatgtaactgaactctttcttgctgtgatgtttacatgtctcataatctcttaagtcattttattgagttattttgttttttggtatctttagttgctgaagaagcatcaagaccctaaaaaccggcctcgtcaagagttaggtgcaccaggcaagccctttgcagggatgattatttctttgtcaggccgtctttcgcgaactcatgtatgtactattatagcccgtagcaggaaccatctttttgtgtattttgcatcacattgccattacataaagcaattttcgttgatgaatgcagcaatattggaaaaagactattgaaaaatatgggggaaaggtctccaattcggttattggtaaaacttaaatccatgtcctgttctctagcttctgaactgcttcagattcttctgctttatgtcttacactagctattactgttgcaataacacatatataggtgtgacttgccttgttgtttcaccggctgagcgcgaaagaggcggttcttccaagctctctgaagcaatgtgagcataggaatctcttaaagttttattattcaatatgtacattgtttgatcaaaatcaacctctacattccttgaagggaaaggaacatacctgtggctagagaagaatggctgcttgacagcattgagaagcaagaacctctgcctctagaagcttatgatgtagtctctgatcttgctgtggagggtaaaggaattccatgggataaacaagaaactagtgaagaagctcttgagtcaatttcagctgaagtatttaattatcaactttatcaagtccttaaggcattccaagaaacatcacctgccaaaactttaatcacaataattgaatctgtgaatgcagctcaaactatatggaaaaaggggtgtccataaggatagtaaactgcaggaacgagatggagagatatttgagaaagatgggatattgtacaactgtgccttctccctttgcgacatgggacgagaaataaatgagtaacatgcgaaaaccctttagcattgtgcttattttgatcaatagactttctcctgaattggtcaagttacagattatgtctacttggtgcagctattgtatcctgcaactgatcaatgtgccagagagtaacctgcacctgtactacaagaaagggagagtcggcgatgatcctggcgccgatgaaagacttgaagagtgggaagatgttgataatgctgtgaaggagtttgttaagatctttgaggaaattactggaaatgagtttgagccatgggaaagagagaagaagtttgaaaagaagagattaaaattctatcctatcgacatggtacaatttcatcagactatatttcacttgcctttaaagtttcgagtgctatggccttatggataagagctttctgataggatgacggagttgaggtgagacaaggagggcttggtttaaggcagctaggagctgcggcagctcattctaaacttgagccgcagcttgcatattttatgaagattctgtgcagtcaggagatttataggtatggcactaaccatattctgttctgcaagcttccttcaaattgcaccctgaggcctggttcaatacaggtatgccttgatggagatgggtttggaccctcctgaactgccaatggggatgctctcggatcttcacttaaaaagatgtaagaattgctcactttctctgtcactctcttgccttcagccttgcaaataactaagcgagcactttcaggtgaggaggtcctacttcagtttgtagaagcagtgaaatccatgaaagggacagggcaaaaggcagaggctgtttggtcagattacagccaaagatggtttacgcttatgcattctactcggcctttgatcctaagagactatgatgaacttgcagataatgtaaactcaacagaagctgccttttatcagaattatatagacaatgccaccatcctttaaattgacacttatgttcatgggtttaatttgtaggttgctgcagcatttgagactgttcgcgacataaatgtagcctcacgtcttataggagacatgtcaggctcaactcttgatgacccattatcagaccggtacaagaaattaggatgctcaatttctccagtgggcaaagaaactgacgactacaaaatgattgtgaattacctggaaagaacctatgaaccaatcagagttggagacattgtaagaccacttaatctttgttcgtctgtgttgttttacattttgtgacgttatttgcgcttgtggtgatttaggattatggagtatcagttgaaaacatctttgctgtcgaatcaagtgctcatccttctttggatgagataaagaagttaccaaacaaagtccttttgtggtgtggtgagatttgaggctttgtccatcttatccttcataataactttatttgctctggctgtagcactaaattccttcaatgtccaggtacgcgaagctcgaacttgttaaggcatttgcaaaaagggttcttgccagctgcttgttctcttcctgtgcctggttatatggtaaaagaaatactactatattttccgtttttacttttttgagttttctaatgtcacagttcctgatgaacttgtttggcagtttggcaaggcaattgtttgttctgatgctgctgcggaagctgctaggtatggttttactgctgtagataggccagaaggattcttgattctggctgttgcttctcttggagatgaagtcactgaggtctcgagcaccccagaggtttgttagtttcaagtctgaactgcattttattttttaacaacctaagaaccctaaaaataattcagctactttctcctcaggacacgaaatccttcgaggagaagaagattggagtcaagggattggggagaaagaaaacagatgaatcagaacacttcatgtggagagatgatatcaaggtcccttgcggccgcttgatgccatcagagaataaagatggccccctggaatacaatgagtacgccgtctatgatccaaaacaggtattgatgcaacttcttttggcttggatggttttgtttaaagtagcagtgcattttcagaatccaacttcttatatgatctgttgaaattgcagacaagcataaggttcctagtgggaatcaagtatgaggagaaggatgcggtgatggacactgcagagccgtga

SEQ ID NO: 71 - DNA, 2734 bp, Ricinus communis
atgggcttatggaattaccatgttcaagacaatactaatctatgctttcaacctcctactttcattgaatggctcaagccatcttcttcttcagttacttcttcatcatcgtcatcctcatgttcttctgctactcaacaagttcagctcacaaatccatccatgaccatactaaaacttcctcttctgtaccctcaacagctagaaaatcaagatcagtttgttaaagaaaccatccaatgcttgcctctttttacagagaaggaagaattgaaggaggaggagaatatggaagtgcaagaaagtgtggttaaagaagaaaagattgaccaggttacagttgctttgcacattggactacccaataccagtagtggagattctgatcttgatcaagttgagactaaagtttctcaagaaaaacaagaacaagaacaaccattcatgatcaagaaaagcttccatggctgtacctttaacgcagagagtaggttttggatcccaactcctgctcagatccttgttgggcctatgcaatttgagtgctccatatgcagcaagaccttcaataggtacaataacatgcaggttagctcaactcaatcccctctacagtctacatatataattattagtattttccttttcttgtcttcatctccacaaatcaattctcttttggatatatttgaaaggatattttaggtacgtatggaattctaataacatcaagaatgactacaaataattgctatgcataacttttatcttttttcttttggcctcaattagtttgagatccaaatcttttttctttctttttaactttgtgtttgtttctttaacaggacaaagatatctatattatagttggtgtgtatagttcatattgcttaggttcttgatcttatatgatcagacaattctaaggttattgcgtataggcatgttatctgtctctgtatatacatacataatatctatctttgcaagaaaaaaaaaaaaaagaaaaagaaaaacttaggcaaagcattcaaaattgtattctttttctgtggggacaagtagataacacaatgcatccatggtaaaaggaaatgataaagttgatcctatatatataatcaatgatcacagttaataattaccattcacacaaaaaaaaaaaaaagaaagagaagagagccataataactaattaaaattaaaaatgtataaattataataaacctgaacaactaattatgctaatttaacatgacttcttttctttcagtatattttatggtcttttgattgtaagaaaccacatgaatttcaaaagaaaagattttcaatccgctttttctctttgttttatcgatatgatctcaaataatgtgaggcaaaataacataccaaatttgtattctaatcttgctagcattatatatagttatatatccactaagtaatggtcaagtttcatatgcaagtaattgattaacacaagaataacaaatggtttctttcttttatgtttttctttccacttatttttgtttttgtgcaattgcttataattaaactttgtagaatttaattaaaagaatttatacttcatctatattttatttaaaacccatcatttgttatagcaaagttttaaaataaatacaattcttttttaacaactttagggttagtttgttttaattgatcttgttttctttttgtcggtaatgaaatttccttccctaagctaatgctaatgaggtctcttccattccatccttgctcacccttcagtgtggaagctaagggaagaaagcaagttggggggtgggagtaagtggaaatctcacaatattagtaaaaggaggtgataattaattagttgaaaaatgattgaagagataaaagttgtcccaagattgtcaacagatgtaaaaagaatatgtgataaagaagctgataatgattaaagaaggcattataaactatacaagtaacttgcaaaacactatcaaaagatatacaaaaaacagaaacaaggccctccatggattaaaaacaaacaaaagaaaaagtaggagagtggattttctttactttggattcttatttctgaactatataactccccaatgattataagcttggaggatcaaatgtaggtgtcatatatatccaaaattaacaccttaattttagcatatctctgctagtttttagaccaatggtagtttaaagtccttttggagactaattaactaaacagaaaatttctatatatggcttgtgtatgcagatgcatatgtgggggcatggatcagaattcagaaggggaccagactcactcagaggaacacaaccagcagcaatgttaaggctaccatgttactgctgcgcgcaaggatgcaagaacaacatcaatcatccaagagcaaagccattgaaagatttcagaacacttcaaacacactacaaaagaaagcacggtgctaagccatttatgtgcagaaaatgcgggaaaacctttgcagttaaaggagattggcgaacccatgaaaagaactgtggcaagttatggtattgtacttgtggttctgattttaagcacaaaagatcactcaaagatcacattaggtcatttggcaaaggccattctccgcatccttctcttgaaggttttgaagatgatcagaaggaatgcattactactggctctgaagaagatgatttcgttcgctag

SEQ ID NO: 72 - DNA, 5178 bp, Ricinus communis
  misc_feature (4657)..(4659): n is a, c, g, or t
atggaagcagcagtcattaccaaaactaccaccgtcttcagattacctccatctccgttatgcttcgccgcactccgccaccgcaactcctcattttcctcgtccactaaaacctctctattatttccccgttttaaagcatctcatcagttgattactcgctgtgctgttgaaagacccgatacggttcgattgttcaaaacctacatctaaccttagtttagataaaggaatgttaaattaatttgttgtgtttaaaattacagggaagttatgatggagccggtgaaagctatgatgctgcttctgctataaatttaacaaatggatccaattttcttcagtcattgtttgattttacatcatctaactttcttcctataggtaattaattaattagtcatttttcacttaacaatttaaagttaaacttgtgtttaattatagtttttctttttggcagctttaataagtgcagtagctttaggaatggctagtccaactcttggttgttatgcgcataagtattctttatcaaagttcactactttcggtattttctttatttcaggtgagatttttgtttcggatacttttttctttttttcctgaaagctttttctttaatgtcttttaattttcatgcaggattaaagttgaaaggtaaagaaattggtgaagttgcagaagcatggcctgtagctatatttggtctagtatgattgacctcaatatcttttttcctcttttatgtgcctagtctatttcattattagtttgaaactttatccaatttgtgcttgtagtattaaggttgtagctatttaggcttttcgtgttctgcattttccgctatttgggtgcatccaagaaaatggttggtctggtatttgacatatgcatctaggagaatgagaataaattgctaattgccttttatgttgatactgttgacggttttctactgtatgcatacttggttattttgctggtctttctctatgaagttaggaaatatagtgtgttttccaataatctggagagggaggctcatttctatgtcatttacattagataggtggtttttgaatatagctgataggttctttagttgagctcaaattaggagcatcgctgcttcattatttatatcttttactctgtccttatttttatttgttctaaatcctaactagttttatttgtttattataccaggcttctatcttgttgtttactcctttcttctcctatctaatattgcaagttcgacttgcacctcaagagtttgtaacaggtattctaaatcctgaccgtgaaccagtatttgcaggataaaatcataatttgcttagtactgttagtacagcaattgtttgggtaattggggttttgaacaggattggctattttttgttgtgtgccaacaacattaaccagtggagttgcattgacacaagtatgcagtatcttttttactccctactatcttaattcccttttgtcgttttaaattaatctcctgtgatacttaaattatataactgtatactttcaatgatggcatttgcaaatttaattgaagcttgttggtgggaatactgcccttgctctagcaatgacggtgatttctaatctactaggagttctaacggtaagtctaaacttggtcttatgatgccagtgatttttaagtctgctgacttatgtcatattttgtttctgattggaaattattttttacaacttctcacagcttccttccttagcatgtgcaccttgtaattgttgaattagatatgcacactgtgccatcttatgcatttctcagttttgtattttccaaatactcaatggtgtgataatgttggtttgatcttgtaggtgcccttttgggtctcaaagtttttagctgatggttttggtgtatccatcccaactaaaaacctattttggagtctcatattcacacttcttgttcctttagttcttggaaaggttctttccttgcctttgtttttatgctccctccttttgttgttcaatatgactattttatgattagcttcacatgctgaattatttacgatcatgaggcattcttgaaagcagaatacagatgaaacatgcatatgactgtttattttttgtttcaatttttttccttaccttggaatacgatgctgttgtaaaagctttggcagataatagctggatgtttccatttcatcattgttattctgtcttgtcttctcacagtttgcgggattttgatgtgctttttcattcacaggtagtccggaatagcttcaaaggtgatgcttttcactaattcatttttgctttctgttcggtaatttttttttattacatctgataaatatgaagttcatatttaactcatgaacattaaccattttcccaacttgtcattgaggaacataaggtgcatctagaattaaaggaacataagctgcatctgctgcagacagctacctaaataattttcatgttcctttatatgaaagtttttcagaagatttgcaaggttggatattcttcctgatgtggcatgaaactaactaatgttaacatacatacattcattggtttaaggaaaaaaaaaaacagaatggttcttacttttatgtttttatatgtgcttttctcccataatatattatcaaaattattctacaggtttggcaacatacattgatgaaaattctaggactttctcagtaatcaatacctttctccttagccttgtaagcactgatcctccaaggcttcttgactattctaagatttcaaaggaaaatgaattagcttttgattttgttcttttctttcctttgttctttttgggctaattcaaataaataatttatttttccctgttcatattttttgttaagatcagttagtaatacctcaagcctagaccctagtagtttttagtctggcaattgaagatcctgcttgtagaaaagtatgaattaaatatgtataggacagcttgcaggactgagatttagattggaatgccatctacattgtatttggttgaaatctatgaaattaatagaattcatctgtaaatctaaagtttatgtgctttgattgaagtgaaagttaatttagaattctacataatcaaatttgtgtgaaattggttatagctaaactaaattgtaataaaataggtagaatttctaaaggaattccagattagtaagtcaattatctatttcaactttatcatttctattttactttctctctcatgtctttttctcaaatgaaatgaattcgttaatgaatttcaaccaaacataacactagagaaatagattctattaggaaaattaccaatgtaaattctggttcagtatggagttgaaacattccaggatcgacacttagaaatcccttggtcaccacatggtccacatccatggtttcctttttcatcacacatatagttgattgcattatgttattctgcaaaattgctggaaatttattcaagcaaatacttattaaccaggcattacaagcatggcatctctttctttgttaattattgaggttattcattaattatctgtcttggaatttgtgtggttatgactaatctatcttttctattgctatgtcatctatacttattgtttcttttgtagaccccatggatgcaagttagtaaatctagatcattgcttctattggttaagccgcaggtgtttactgaagctatcgcgatgggaatgtaagttctccatttaccaccacctatcatttctgtgttatgtgatagtgcaattctctacgtttatgcttgtagtacttgaacatggactaaaacaacttttcacatgcaactgatatgactattttcagaaagatgttttatttggaattttagagatagccttttacattgtaatctggagaagggaaagtaaggcagttgcaatattgaaattgatgagatggatgtctgttattagtgtccataaaaaaaaaaaaaaatctaactgtttaaacaatcttctggtttctggaaatggccaaagaataacaaaagatgtaagaattaaaaaaatgcacatacagataaaatcttgaagttacaaaaattgggtgcatatatacagggacgagacttatacaaggccaaaatcatatattgaggagacatgctattgtctttgaaagaagaagacttttgcaacgacaatgtcgtctcagaggagatgtaaattggacttcctgttaatttatattattgcattacccttctcctatgcatacactctaagagcaccatatcatggcgcagaatactaatgccatttgctgatttacatgctgtgctcttttctttattgtgcattgtttgccaaatgttgcttatgcagacagaacggaaaaatttagtattgtctttccattgccaaacgatgaattctcttaattataaaagattgctgtgtacttctgctttcagacttgtgcatctcgttttactgggatttaacatcattttggtgaaagccttatcagctggatttggcggtagagagtcagttcttgcaaagagaaagaatgcccgagctctcttgattgtctgtagtcaggttagtctcttgcnnngcttccaagcatctaacaccaagaattttagcaagcactagatatcctgcttacctctctactttcctggccggcctctaaatttatacacaaattgactatggtccttttgctatatatatgttcgggtcccattactgtttcaattggttttcgtaatatgtaatggcatgtcttctattctatataattacacgatacaagaagaaaatccaaagtggttgaaagagtaaaagaaaacgcaaaattgaggaattggacatcagcactcggttcatttgtgttgactactgcacatgaggtcttactttctataattttcctggtttgcagaaagcattgcttactgttatagttgtagtggaacagctcagtggtgcacttggtcaatctgggctattaattcttccttgcgttgcagcgcatattaaccaggtttctcttgttttctcttcattccaattcttaatttcttctttcttggtttttgtttcttagtttttcacaggaacagcataa

SEQ ID NO: 73 - DNA, 210 bp, Ricinus communis
atggtgagctatgaaatgccaaggccaaacataggaatacacaggtttgtgttcctcttgttcaagcaacaaagaaggcaaacagtaaaaccaccaacatcaagggataggtttaattcaagaaaattcgcagaagaaaatgaacttggcctgcctgttgcagctgtcttctttaatgctcaaagagaaacagctgcaagaagacgctaa

SEQ ID NO: 74 - DNA, 2618 bp, Ricinus communis
atggtagttggatcaacgaagaagatagcagttgcttcagctacagctcacactagaagaaacaaagctacacccacttctttcccactttccctctgtatgtatgtattttcttttttttcttttttttttcttgcttgtgtctttacttcttttggctatgttttcttgtttcaatcttgatttctgtttgtgggttctgttttagtttcagctctgtttcgttggtttctttctgttaaagtctgatgtgtttataagtttaggagtgtaagactatgtgtttgtgtatggattgatgtgtatcttggaacttcaaggtgttaagtttgagatagtagttaagtattacatggattagattcacatttcatactattgtaaaactagtattgcataccagatacataattcttgtatttgtgcaagtatgatccaagattatgttttaaatacagaaatgaactcagtgttaattagcttgattttagaatacaaattctgtctagaaaacccaattactaaagtgtccaaaaccaggtttttggtgtaaacaaattaaagattttgattgatttgtactagcatagtgctctgcagctaaaatgcagctacatttctctttcttgggcgcaggcttttatttaagataattatccacactgaatgtccacttcttaaattctttctgacttttgtaacttccgtaggagatgccttctctgtgctatttccttagctctcagttgatggattttctagttttgaatgccatgtatattactgcagtaacagtgaggttgctgcaaatcattaaaaacaacattacttaataagttcttcaaacaaataagagcatttaccctggatttaagtttcttcgtctataacaaagtaatcttaccttacatatatcgcctgtatttactgcatctgttaccttgctaatagaaatgttcagtctttctgtccagcaatgtttgtaccaatagcagtgactgtagttgtgggtcttctgggttttgcctatcagtcgttgaaacctccccctccaaagatatgcggatcgccaggcggtccgcccataagttcaccaagaatcaaactcagcgatgggaggtatttggcctacagggagaagggggttcctaaagaagaggctaagtacaaaattatcgttattcatggctttgacagctcaaaggatctggatttacctgtctccaaggtacagactgaacgcactcctgcaatgcttgcatctccagtaaaaaaacttatgaatttgtggttatcttgcacttttatggcattgccatgtgagtgacaatgagcttcaacatcttgattactagcaaagttggtagtctagcagattaaataacgagttgtccgactctgatgcaatatccttgaacaaaaaggctgagacagactgataaaggctagaaagaaaaaggcttttaggtgtgactagtatcaaattggagtagtagcagttttgaattgtatgattaactttgccaggacaaaagaaggaaaatgaaaataaaaggttgtgctttatctgctgtggactaaactaattcatcagtatgctttgatgttcaggatttcatagaggagctaagggtatatttccttttgttcgatagagcaggttatggagagagtgatccatatccatcacgctcagttaagagtgaagcatatgatatccaagaattggcagacaagttgcagatcgggccaaaattctatgtaattggagtatcaatgggagcctaccccatatacggttgcctaaaatacataccgcataggcatgatactttttactaccagcttttcacttaacttttgaggtttttgaatgcttgggtttcagtagtaacaaaaattcttctaaattaattacaggttggctggagcttccctcgtagttccatttgtacactactggtggccttgtctcccacccaatatatctagagagggcttacaaaggcttcagaaatctgatcaatggacatttcggattgcacatcatgcaccctggttgttctactggtggatgactcaaaaatggttcccttcattaagtattatgtcaggaaatgtagcaatcttttgcccacaagatatagagatgatgaagaagttatctgaaaccccaagtgttgttcaggtagttaaagttgtgatgcagcattagcttatgatattttggtatttgcattagattcgaaatgcgaattcttgtgttgatttctatttcaagtacatttactagcaattgtaacaatatgttatgttttggaatacaggaaaaggttcgccaacaaggtgttcatgagtctctgtatcgagacatgatagccggttatagcaaatgggaatttgatccctcagatataattaatcctttccccaacaatgaaggctcagtccacctttggcaaggttatgaagacagaatcattccttatcaaataaaccgatacatctcagagaagcttccatggattcgctatcatgaggttcctgatgctggacatttattgatcttcaggagtgacatatgtgagacaattcttaggtcacttcttcttggatga

SEQ ID NO: 75 - DNA, 1593 bp, Ricinus communis
atgtttactgttgcggcagcagcagtggtggtggtgagtcttgcagtgttaggatacgaaagggtaaagcctccacctccaaagatttgcgggtctccgagtggtcctccaattacttcaccaagaattaagcttagtgatggaaggcatttgtcttatagagaaaggggtgttacaaaagaaattgccaagtataaggtcattcttgttcatggttttgatagctctaaggacatctacttgccactatctcaagtatgatctctgcgtacacattaatgccatatattagaatttgtattttaattaggaactcttgtataacttacatgtattagtatgagagctttgtaagtctccacaatttcaataaccgaagaagataatttcattgattataaattgcaggaggtgatggaagagctaggaatatatatcctgacatttgatagagcaggttatggagaaagtgatccaaacccagaaaggtcagtgaagagtgaagcatttgatatccaagaacttgctgaccaaatgcaactgggtccaaagttttatgtcattggagtttccattgggacttactccatttgggcttgcctcaagtatattccacacaggcatgtcactctttcccctactgcatctccacatttatttcttctttacattattttttcatttttgtcgacaattgttaaattatgctaatgcaattaaggattgcactcgacagtagcccactggcatgatgtaaaaatctaatccgaattaacaaattgccaaatcttattgcatttctaagtgttggatgttttctgtattaacaaaatgttgatttctgaccaagattgaccacaggctagctggtgtgactctagtagttccagtcataaatttctggtggccatctttccctcctaaattggcaaatgaggcattcaggaaacaactcaggagagatcaagtaaaactgaccattgcacatcacttccctccactagtgtactggtggatgactcagaagctgtttccttattcctctatcatgcaaagacacccaatactactcaatccaagagatttagaaactataaagcaaatgtctcaagtgcctaatcctgatgaggtatcttcttctcttccccattttttcttgggtacccataatataaaatgagtttttctttttaagaagagaaaaacgaatacgcatatactgatgttgattcctgaaacatgcactacggttttatttgaaatgattggtaatgtttgtaatgacagcataagataaggcagcaaggtgtccaggaatcactacatagagacatgatagtgcattttgggacatgggaatttgatccaatggagctaaagaatccatttcctaacaatgagacttctgtttacctgtgggaaggtcatgaagacaagcttgtgccatttgaattgcagagatatgttgctaagaagttaccatggatcaaatatcatgaagttcctgatggtggacatttgatgattcatgaaaagggcttgtgtgaggctatattcagggaacttttgcttggagaggaaccctttttttga

SEQ ID NO: 76 - DNA, 1733 bp, Ricinus communis
atgcttttaaaaatagcagttcttctgatgagtggtcttctaggcatggtttatcaggctacacagcttcctccacctcagaaggaagagtcacaagaaaatactcctgctaattcaccaagaatcagactcagtgatggaagatatctggcttacagagaaaaaggagtcaccaagaacaaatccaagtacaggatcattattgttcatggctttggaagctcaaaagaaatgaactttctggcaccccaagtacaatttttgaactctcttctctaactttactttatattaaactaaaaaaacttttcacattttaatttgggattgctccattgaagcatagggaccgagatgatgattcaagtgttgttgggtaaacaatattgagttgaatcaaaagttcaagaggaaactgtttgaatggatagaaattgcccaaagacagcactaaatcctatatttactgaactgtctatttaacaaaccagttctcatttcaagttcatttagaacttctcatacatttaatgtatagaagtgattgtgatcatacacacctaaagacatatggggtggtcttatataaattctgcttctaaagattctgttcttatgttcatttaggagcactacactacaatatgaattggtaaacctttccgcttaacaaagaattacctgcttgcttgaaaacctgtaaatgtataaataaagtgagtttcacattgctttagttttcaggaactgatagaggaattagggatatattttctgctgtttgaccgagccggatatggagaaagtgatccgaacccaaatcgaattgtaaagagtgaagcgcatgacattgaagagcttgctgatcaattgcagataggatccaatttttatgtgataggagtctcaatgggctcataccctatctggagttgcctcaaatatataccacacaggcagattcaatcagaacctctagctgcaatgcatagctttctacctgaattttgtcaataagattcccattactcacctcaaaaccacttgtgcaggctagcaggtacagcattaatagccccagttgtcaattacagatgggcttcacttcctcagaatttgataaggtatgattatagaaggaaacttatccagtgggcactctggttctctaaccatgcccctggattattacactggtgggttactcagcaatggcttccttcaacttctgtcctggaaaagaacccattattctttagcgatcaagacttagaagtcttgaagaagataccaggattccctatgttaagtaaggtaactatacaatgctccacatgcatgtaaagaaagaggacaaataatttacattgtagtatttaaattctgatagtttgtgcttccaactacaggaaagattaagagagcgagatgtttttgataccctccgccgtgactttatggtgggttttggagattgggaatttgatcctgttgagctagaaaatccatatcctcaaaatgaaagctctgttcacatctggcaaggctacgaagacaaggttgtaccatttcaacttcagagattcataacaggaaagctaccctggattcgataccatgaagttcctcaaggtggacatctaattgtgcactataaaggtttctgtggggctgttttgaggtcgcttttacttggagaagaccctctagaactagaacaagttcatccataa

SEQ ID NO: 77 - DNA, 1811 bp, Ricinus communis
atggtactttctgaatcagacactattgtctatggcagcattaccaaatcaaactcaccaccattatcacatccacagtcacatttacaagacgagtcaatgaaggatgcttcattttctccattgagtggacaaaattcacttttgtcccttactctcaatgaaatccagcacaagagtggcaagagctttggttccatgaacatggatgagtttcttgctaacttgtggagtagtgtagaagaaaatcaagttactccacagccaaatcaactccagcatgccaaagacaatggtagtgtaattaacctgcctccattggcgcgacaaggctctttctccatccctgctccgctatgcaagaaaaccgtggatgaggtatggtttgagatacaaaaagagcaaccggaacgtcaaaaaccaagcaatattgatgctcgtgagccccctcaacgccaacagacgcttggagagatgacgctcgaagatttcttagtgaaagccggtgtagtccaggaagctacacagtcagcaggttcatcgctgcagaaaatggttacacctattcaaaatattaatgcatgtttggatgcaagttttggaatggggcaagtgatgggaatgggatttcctactgcccatcaaactattggaaacagtttctctaccggcaacggcttcgcgccataccagatgttccctcaaagcaaagggtttataggagaagcaccaaacaatgcgaaaaccgaacagggtcaaacggaattgggcatgcaacaaaacaagaaaaggataattgatggtccaccggaagtggtagtagagcggaggcaacgcaggatgataaagaatagagaatcagcagcacgatctcgagctaggaagcaggtcttgtcttgtgctcattcataaacatcaatctctagatatattttacatacatattgtctcaaattatctctgaattgcttggtgatgcaggcgtatacggtcgagttggaattagagctaaatcaacttaaagaagagaatgcgaagttaaaactccttgtggtaagtatattgcatatcttccacttgggtaaattatattggcgaaattacattagcgattatcaaattatcccactttataatgaaaaaatatcaaatttttgatttataactaaataattactgaattttaattttaataacattgatgagtttttccaacataaatgagaatagattgcatgagcagttactataatttacactttgtaataaaaaaaatagcaaaattttaattttaaaaaatacataagtggtttttttttgtaataaattaaaagtttaataatatttttattatagtaaaatttagtgactattcatgtaatttattttctaagaatgttggaataatttattagtgatattaaaattaaagtcgactactatttagttatagatcaaaaatttgatatttaagtgtaaaatttggcaactgacaatgtaatttagttttttccgctaaataagaaaacagattatcaattttttgtttatcatgtgctctctagaactaatatgagattatgttttcaaacttaatatatgaaacaggaggaaatcgagcaaaatagaaaggaagaggtaaactttacagccacgtaaaattcggattaattgctaattatataggtacatttataacttggttgtgattataaatttttcaggttttgaggaggaagccattgataatgccaaaaaagaaggtagataaattgaggagcataaggaggacagtgagcttgacatggtga

SEQ ID NO: 78 - DNA, 7901 bp, Ricinus communis
atgttaagttcggggaataataatttaagccgtggaagtgccgcaatatcatcagatcttccaccattgacacaatgcttgcctttggagcaaattacgttaggcaatcagaaatatactcgctgtggagagttaaggagggctttgggtgttcctctaggaagtgcatcagaggattattcttttggagtttcccatcctaagcctcaatccctagcgggtacggaggagctaaaacattttaaagaaagtgttcaagatacttctagaaaggccaggtatgttagcatttctttgcagcagactacatgaatttatggttggccgtgccattagttatttcttgcattcttcttttacacttgaagtttagtgtggaaaagacttggaattttgttgtaagggaagtttgattccaactatgtggcacaactagaggtttatggaagagagagctacttcattttttatttcatcttctgggtcagagaaaatttagtggctgcgcatcctaaaaaatagaataacaaaggataatgattattactttttaattcatgcctttaattcacatgcttagtcctgaaatttctgcattttgtagtacttatagtccatcgaaattctttttgttgcttcatatgttgactgtccatgtttcgcttcagattttgtaactaaagatattttcacaaaacactttcctagctggatgctgatgatatgatgtttttctatcagggatcgagcaaaaatgtggcgtgattccttattcaaattggacaagtatagggaagcgttgagttcaaagaagcgacagaggagcgaacttccgttgaatgagaggtcaaatggagcaactttagcaaagatggggagtcaggttcatagaaacagtcatgatattatggctcaaaggttggaggacagggctaaaaatattgggctgaataagcgggttcgtacatcagtggctgatgtgcgggtttgtacattacatattaatattgtagtctgatatgcgtgtataagttttctgttctgattttttattgcatatatattagccagggtaacatgcagagggtaattgatttcttacttcctggttttctaatctgcttacacagctgtagatttcttttgaataaaatttttaaaattcccttttcccccgctttcatgttgagtatctttaaatagtgatctcaagtagttagtttctttttcttataaaaaataattgcttatgcaatccctccttccatttttgagaggcagaaagggttttgaactgtgactgcctatttgcagaacagctgggccactggttcttgtggctggttcttacatatatttaacatgcatgcatttctttccatttttttttaattttatttcttttctttgatgcaaccaggcagatggtaggtcaaaccttgcctcaagacagcagatggtcatggagaagggtacagatatgctccaagattctggtggaggtactgttcggtttgaagaaaagatccgtagattgcctgctgggggtgaaggatgggatacaaaaaataagaaaaagcgctctattggagttgtgggtagtagaattttaaatggtgatcgagaaataaaacgagctatgcatcctaaaatcagtgctgagtctaagctgcgatcttgcgatactcagggtttcaggtaaagtagtacatccatgtacttgattagtgattttatgtttttggtttggtattgtttctcttacagtccaaataaagctcagaacctgtttataactgccagtataggaagtgtttagtttcgatagaattgttacttgtttccaagactgttatctgtaaatgatatgctagtgtgttggtgttcatattttgtcattgtaagtttattgctgtgataattgtcaaatcattctactctgcaatttttgttgaaagaacaatgctgacaagtacggtgaaggttgtttatttaagcaactttctcttgagacctgccactagcggtgatgacatcttccttgaggttgatgtttgggggaagggggactaagtcattggcctttcagttactccggatgaaactttggttccacggttatgatttatatagtacgtcttagttgattagaaattaattaggaggaaaatactttttcctttgttcttggccgtgtatctctagtttgtcattgccattgctgatcttcataattacgatggatcctctgtcctgttgactcggccattgttatggtactgcttgaaattgttctattttttatgttatgatgggaaaaaaaaaggaacaagtttgttgtgttaatgagtttcttatgtgtcgcaggtcaaaatcttcccctggtgttagtggaatcagtaagttggatggtcctttagaacctactggttcagataccagtacagtgctcaggaatgaaatggatactgtaactcttccaagagaccgattagcactcctagagcagaaggctgtgacaaaaggaagcaataagtatgtattgtccttttgaaactattgtttatcctattaagtggagatgaagagtcaggaaatgatggaaaagctgtaaagtttgaaatcttgttgtatttggtgcactatcttcttttctggacgaatatagtcaggttattaatctgtttgtggtgctatgtatcaggccaaatgttaacgaagacaatttagcaagcagtcctaatacaatgatgaaagcaaaagctcgggcaccacgaactagctccatcatgatgctagactcatcgctcaaagttcagtcctcatctacatctcttcaaggtgcggaactacctgcaagttcaaataaagtaacaatgccttgtatgctaaataatcataagcgtcaaacatctgcaggttcatcttccgtggctcaatgggtaggtcaaaggcctaaaaactcacgcactaggagaacaaatatagttgctcctgtttcaaaccatgttgatgctcagatttcatctcaaggttttgcaaccaatgattttagcactagaacttccactgggacaaatggatctctaattgccaacagtatagataatcacactcctaagttcaagagagaaattgacattgggttatctgaaagtgaggaatcaggtgctggggacaataaaactaaagaaaaaggaataaacagtggcgaggttgctctaacttcatctcagagagctggtcattttcttttgccttctaaaaaaaataagttactcacaaatgaaattggagatggagttcggagacaaggaagaagtggaaggggttcatctttaacaaggccaggcattcacgtagtgagagagaaactagagaatctaccaacaataaagccacttcagagtgtgaatgctgtttctgataaaaataaaaggtgtttatcctcaacactctcctctcccgagtcccaaccaaaatgttgatcaaatcttagtttatatgtcatttggcagtattctgaatatttgaaatatgtttggtttctttgaatcagcaaaactggtcggcccccttccaaaaagttgaaagatcggaagtcttcagctcgcgttgggccgataattaatagtggatctttagattatacaggtaagtgttatttattcaatgaatttgtcgtatcaatttgggttttgcattattaactttttgataatatatgacactgctaggcattgttgtctaagaagggtatttgaaatctctttgctatatttcaattattaggctgtataacagtttttctcttttggaaaaactctatcttgtggtcatgatacagctcttgttgtcacatttcgtaggtgtttagaggtgtgtcagatgttagaatgggctttgattgatatgtgtctattgcatagctgccaatgccctcgcggactattttgtttcctttctcctttcttttttgggttctgatattttgagttccacatatatgcagtgactttaacttggctaaaacctagtagcgtttgtgcaaactctccttgatgttaatcttgccaacatgttttctcatatatgcttttcttttacaggcgaatctgatgatgatcgcgaggaactattttcagctgctaattctgctcggaatgcgagcagtatgaatattgatctctttcttaatttcatctccagataagccatctttgtgttatttcataaactaatacttgtttgctttagtagatcgtgcaagttgtggcccgttttggaagaaaatggaatctatttttgcttctgtaagctcagaggacttgtcctttctaaaggaacaggtacgaggttatatggatagattttaaaattttatcttttctcatgggccagggacttactatttctttttcattgctgttaaatcagcttagttttgctgacgagcttgatgagggtttgtctcagatgcttggtagtgaatgtaacctcttggtaatgcattattattgttttctcccctttttgcaagccttctacatttctatattatgaggataaatgtttcgagttccagtttatgtaattcaagcagactttcaattactaaaatcagtctatctggatctcaagttgactcggacaaatttatcattatttactaatgaaagtttaatgtttctaaagagacataggttaactctgaaattccttctttagggtgttcttgtgcaaaaggaactacctgattattgtggtgaaagacaaggtgatcactctaatcaagattcagttaagaaatctgctctatatggaaaagttgacatgggaagattggaaaagggtgctccattgtaccagagagttctttctgctttaattgaagaagatgaaagtgaagaattttatatccacagtgaagggaagaatatcccacttcactatgctagtgatgattctcattgtggttcatgtaatctgattgatattgaatccaaggatagggataggatggaatctgaagttgagtcaacagtggattttcagactcacaggaattctttcttggacagaatttcatgtgataagagtgttgcatctaacacatttagaaattcaagcatgtcaaactctttacatagcaatggtcagtggccaggagatgatgatttttcccattcagatattgtgcatgccagtgaaatatgttcaaatgatctcagtcagctgcagacaagggacttgaccatatctgccttcccctcctctgatcacaagtatcagctgatgtatcttgatgatagggttctgctggagttgcaaagtattggtctatgtccagagacattggtatgcttcgtcttgcatatggagtgttttatcaagtcatatttggctgcatttactgatgtcatttctgttttcgtatgtttctgttaccttattgcagcctgatctggcagagggggaggaaatgattggtcaagatataatggaactcaaggaaggcctataccagcaggttgcttgccacaaatacattttttgctcaatttgtgtatctggagttattattttcttaaaaagagtttctttgttaataaacttgatttcctttttccctttcaagttgctttggatcttttttgacacctttgattaaccaacagattggaaggaagaaaaggaagttagggagaattgataaggctgttcagaaagggaaagaagtggaaagaaggttagttttctatgatcaggatcatgggatgagttatggatgttaaactgaagaaatatggactggagtaacacgttttgatttgcaggacgattgagcaaattgcaatggaccaacttgtcgagctggctcatagaaaacgactggtattagtaactttcttgttcagctgtttaagtcaaatcctaagggatttatagaatgtagaaatttaattttgttcctgaaaatattagggagcattcaattgggacatatttacattcttggcatacaaaagagatataactatgaactaacctgtatggtctccatcaacatgctagtatagtattatgcatacagaaactttcaaatggagttatgagttgggacttagttgttgacatgttgcgtaagtttaaatgaccatcccttttgcagtcccccctctccttttgcacttgggtgaataaatttcaaagcaacccttttttctttttcaactccacgtcttgataaaaaaaaaaaaaaaactttcatggccataagatctaatctttcatttatggtaagaattttttgagtaaacatgaaaatcatttaaatcattcttggggtcctgcattaaggcaaactgtcggtcctggatcgaaagaaatgtgtaatacatttggatatgttttatcattcatgttggaccttattttcttgtgctcagtagtttgcatgccattaaatcttatgtggattggtccaaaatatgtgcttagaagcaatagagatatcagtgtaaaacatacctcaatgatcatagagaagatagtctgaaattagagaatgtaggaaggatgagaacaaggaaagattttattacttctctaccattactttcatgaaaatcaatggttcaataatgtttaaaaactagggaatttgtgaatttagtggatcctctagaaaaatatggatggtataatccatatggtgaactggcctttttgttaataatggttcattgaattttccacttcattcattttatgcaggcttgccgtcggaacaattcctcaaaaagtgcagtccgcaaggtttcaagacaagttgccctagcttttatcaagcgcactcttgccagatgtagaaaatttgaagatacagggagcagttgctttagtgagcctgcactacaggaggtcatcttctctacacctacatgcaataatgatgccaaatctgttgattgtgtcggctcaggtactgcaagtaacacatgcaatgaagtttctaaccatcatggcgaagccagaggatcaggtataatatttgcattctctatcatgatactttatttgtttaggagatttatctgtaatgtggtgtgcatggttgaatgtctgagttcaggaaacgtaatactttaaaaggactaattaatttatgatagtaatataacttgttgcccttttttgtctgtaactttagaaagaaataccttttcttttccccatttatttcctaaatatccaaagtagatgtgctaagcaacaaaatatgattctttgctgttacagttgccatttccagcacttttgagatagatgattcacatggtgattacttcgatagagggaggaaaagggaagtgcttattgatgacgtgattggcagtgcttcatcaagggttacatcgagtcttgacagtgctgtgcttggtggagtgaagggcaagagaagtgacagagaaagggatataaacaaggatattataagatgtaattctgtttctggaactagtcactcatcattggatggcttgaaaaatgaccgcaaaacaaaatcaaaacccaagcaaaagaataatcatttatcgacatcaggaaatggacctcgtggatctagtcattcagtggctggtcccagcaataaattagacagtgcgggctcaatgtcgcttggggatgcttctaaggaagcagaagaacccattgattatgcaaacttgcagctgcatgaattagacacaattggattagaagtatccaatgagcttggcgggccacaggatcttggttcatggttgaattttgatgatgatgcgttgcaagaccatgattctatgggtcttgcaataccgatggatgacctcacagatttgcagatgcttatgtag

SEQ ID NO: 79 - DNA, 1185 bp, Ricinus communis
atgggaaagagagataagaaacagaggcatcataatcaacacagaagcagagtagcttcttactacaacacagaacaagaagatgatggttatagctattcacagtcttccttacctaatgaagactcagacgcagaacctgatgatgttgaagaagaagaagaagaagaagaagagaaagaggacactagtgatgcaaaagcatctaatgacgttccttcaaagtttcttctttaccaacaatctgtacagtcgcccaaaggagatataagctatttgcaaaagttctttttactgtatgttggtgggaggttgcctcttcatttccaggaagatttctgcgggactgctcttttaagtacagaatggctacgtagtgactcaagacggactgctgtaggagtggatttagaccttgaggcactaaattggtgcatggcgaacaatgtaaataaaattggggctgatggatattccagaatatccctctttcatggtaatgtcttgcaaccttctgatgctgaattagtcaggtttgagccccaagatctgataagtaacatcaaattgggagagcagggagacaattctgagaatactgcactggaatctgctctccaagtgggttcatcagcttctgttagtgataagtacttgaaaagaaactttcagttaccagcaagagacattgtgtgtgcctttaactacagctgctgttgtctccataaacgagcagatctggttttatatttcaaacatgttcttgatgccttgtccaaaaagggtggtttatttgtgatggatttatatggtggaacatcatcagaaggcaagctaaggcttcagagaagatttccaaattttacgtatatctgggagcaagctgaatttaacataattgagcgcaaaacaaggatcagcctccactttcatcttcagaagcagcagaagaagcttcgccatgcattttcatacagctggaggctgtggtcattgccagagatcagagactgcttagaagaggctggatttaaatccattcacttctggcttcggaggatgccagacagcaaagacaacaggagcgtagagggattcgggttcgggcgagacataaagtacgaggaggtcaaaacttttgaacaagaagattcttggaatgcatacattgtagctgttgcatag

SEQ ID NO: 80 - DNA, 519 bp, Ricinus communis
atggcggaagagcacagatgccaagcacagcgtctctgcgtgaacaattgcggatttttcggtagtccggccacgcaaaacctttgttcaaaatgtcaccgtgatctccaactcaaagaacagcaatcttccaacgcaaaactcgccttcagccaaaccctaagcgcatcatcgtcgtcatcgtcgtcatcgtcgtcgtcgccgtcagcggcttctgtttctatttctatttcatctcctccgatcgttgacctaccggaggtcagcagcaaagctgaggtggtggtagaggataaggaggagacagcggcggagacggtggtgcggccgaataggtgcttgacgtgcaggaagcgcgtggggctcacggggttcaagtgcaggtgtgagatggtgttttgtgggacccataggtacccggagcaacacggctgtacttttgattttaaagctatgggcaaaaagcagattgctaaagccaatcctgttgtgaaggcagagaaattggagaagatatga

SEQ ID NO: 81 - DNA, 1305 bp, Ricinus communis; identical to SEQ ID NO: 69

SEQ ID NO: 82 - DNA, 2448 bp, Ricinus communis
atgaagaaggtccatgaaacaaggtctcaaacacatggaccagcggctgatgaaggcaaagtaatgacaagaaagcagaaggcagagaacaagggacacgaaggagaacagtctccaaagaaggccaagaacgaaaatgattccagtcatgctaatgagaaaactaagactgacatttctaaagagtttgaggagttctctagagcaataagagagcatctctctgtttctcaaatgcgagaaatactagagatgaatgatcaagattcttccggctctgatggggctgttatcaccaaatgccaagatttattgttgcttgggccacttgggaaatgtccattgtgtgactgcactttggaatttgatggcaaaaggtattcttgcaacgggttttacagtgagtggtctagttgcactttcaagacaagaagtccaccaagaaaagaggagccactcaaattccctgattctgttctcaagtcccccattgcagatttgctgaagaagcatcaagaccctaaaaaccggcctcgtcaagagttaggtgcaccaggcaagccctttgcagggatgattatttctttgtcaggccgtctttcgcgaactcatcaatattggaaaaagactattgaaaaatatgggggaaaggtctccaattcggttattggtgtgacttgccttgttgtttcaccggctgagcgcgaaagaggcggttcttccaagctctctgaagcaatggaaaggaacatacctgtggctagagaagaatggctgcttgacagcattgagaagcaagaacctctgcctctagaagcttatgatgtagtctctgatcttgctgtggagggtaaaggaattccatgggataaacaagaaactagtgaagaagctcttgagtcaatttcagctgaactcaaactatatggaaaaaggggtgtccataaggatagtaaactgcaggaacgagatggagagatatttgagaaagatgggatattgtacaactgtgccttctccctttgcgacatgggacgagaaataaatgactattgtatcctgcaactgatcaatgtgccagagagtaacctgcacctgtactacaagaaagggagagtcggcgatgatcctggcgccgatgaaagacttgaagagtgggaagatgttgataatgctgtgaaggagtttgttaagatctttgaggaaattactggaaatgagtttgagccatgggaaagagagaagaagtttgaaaagaagagattaaaattctatcctatcgacatggatgacggagttgaggtgagacaaggagggcttggtttaaggcagctaggagctgcggcagctcattctaaacttgagccgcagcttgcatattttatgaagattctgtgcagtcaggagatttataggtatgccttgatggagatgggtttggaccctcctgaactgccaatggggatgctctcggatcttcacttaaaaagatgtgaggaggtcctacttcagtttgtagaagcagtgaaatccatgaaagggacagggcaaaaggcagaggctgtttggtcagattacagccaaagatggtttacgcttatgcattctactcggcctttgatcctaagagactatgatgaacttgcagataatgttgctgcagcatttgagactgttcgcgacataaatgtagcctcacgtcttataggagacatgtcaggctcaactcttgatgacccattatcagaccggtacaagaaattaggatgctcaatttctccagtgggcaaagaaactgacgactacaaaatgattgtgaattacctggaaagaacctatgaaccaatcagagttggagacattgattatggagtatcagttgaaaacatctttgctgtcgaatcaagtgctcatccttctttggatgagataaagaagttaccaaacaaagtccttttgtggtgtggtacgcgaagctcgaacttgttaaggcatttgcaaaaagggttcttgccagctgcttgttctcttcctgtgcctggttatatgtttggcaaggcaattgtttgttctgatgctgctgcggaagctgctaggtatggttttactgctgtagataggccagaaggattcttgattctggctgttgcttctcttggagatgaagtcactgaggtctcgagcaccccagaggacacgaaatccttcgaggagaagaagattggagtcaagggattggggagaaagaaaacagatgaatcagaacacttcatgtggagagatgatatcaaggtcccttgcggccgcttgatgccatcagagaataaagatggccccctggaatacaatgagtacgccgtctatgatccaaaacagacaagcataaggttcctagtgggaatcaagtatgaggagaaggatgcggtgatggacactgcagagccgtga

SEQ ID NO: 83 - DNA, 1032 bp, Ricinus communis
atgggcttatggaattaccatgttcaagacaatactaatctatgctttcaacctcctactttcattgaatggctcaagccatcttcttcttcagttacttcttcatcatcgtcatcctcatgttcttctgctactcaacaagttcagctcacaaatccatccatgaccatactaaaacttcctcttctgtaccctcaacagctagaaaatcaagatcagtttgttaaagaaaccatccaatgcttgcctctttttacagagaaggaagaattgaaggaggaggagaatatggaagtgcaagaaagtgtggttaaagaagaaaagattgaccaggttacagttgctttgcacattggactacccaataccagtagtggagattctgatcttgatcaagttgagactaaagtttctcaagaaaaacaagaacaagaacaaccattcatgatcaagaaaagcttccatggctgtacctttaacgcagagagtaggttttggatcccaactcctgctcagatccttgttgggcctatgcaatttgagtgctccatatgcagcaagaccttcaataggtacaataacatgcagatgcatatgtgggggcatggatcagaattcagaaggggaccagactcactcagaggaacacaaccagcagcaatgttaaggctaccatgttactgctgcgcgcaaggatgcaagaacaacatcaatcatccaagagcaaagccattgaaagatttcagaacacttcaaacacactacaaaagaaagcacggtgctaagccatttatgtgcagaaaatgcgggaaaacctttgcagttaaaggagattggcgaacccatgaaaagaactgtggcaagttatggtattgtacttgtggttctgattttaagcacaaaagatcactcaaagatcacattaggtcatttggcaaaggccattctccgcatccttctcttgaaggttttgaagatgatcagaaggaatgcattactactggctctgaagaagatgatttcgttcgctag

SEQ ID NO: 84 - DNA, 1230 bp, Ricinus communis
atggaagcagcagtcattaccaaaactaccaccgtcttcagattacctccatctccgttatgcttcgccgcactccgccaccgcaactcctcattttcctcgtccactaaaacctctctattatttccccgttttaaagcatctcatcagttgattactcgctgtgctgttgaaagacccgatacgggaagttatgatggagccggtgaaagctatgatgctgcttctgctataaatttaacaaatggatccaattttcttcagtcattgtttgattttacatcatctaactttcttcctatagctttaataagtgcagtagctttaggaatggctagtccaactcttggttgttatgcgcataagtattctttatcaaagttcactactttcggtattttctttatttcaggattaaagttgaaaggtaaagaaattggtgaagttgcagaagcatggcctgtagctatatttggtctagcttctatcttgttgtttactcctttcttctcctatctaatattgcaagttcgacttgcacctcaagagtttgtaacaggattggctattttttgttgtgtgccaacaacattaaccagtggagttgcattgacacaacttgttggtgggaatactgcccttgctctagcaatgacggtgatttctaatctactaggagttctaacggtgcccttttgggtctcaaagtttttagctgatggttttggtgtatccatcccaactaaaaacctattttggagtctcatattcacacttcttgttcctttagttcttggaaaggtagtccggaatagcttcaaaggtttggcaacatacattgatgaaaattctaggactttctcagtaatcaatacctttctccttagccttaccccatggatgcaagttagtaaatctagatcattgcttctattggttaagccgcaggtgtttactgaagctatcgcgatgggaatacttgtgcatctcgttttactgggatttaacatcattttggtgaaagccttatcagctggatttggcggtagagagtcagttcttgcaaagagaaagaatgcccgagctctcttgattgtctgtagtcagaaagcattgcttactgttatagttgtagtggaacagctcagtggtgcacttggtcaatctgggctattaattcttccttgcgttgcagcgcatattaaccagtttttcacaggaacagcataa

SEQ ID NO: 85 - DNA, 210 bp, Ricinus communis; identical to SEQ ID NO: 73

SEQ ID NO: 86 - DNA, 1149 bp, Ricinus communis
atggtagttggatcaacgaagaagatagcagttgcttcagctacagctcacactagaagaaacaaagctacacccacttctttcccactttccctctgtataaatgttcagtctttctgtccagcaatgtttgtaccaatagcagtgactgtagttgtgggtcttctgggttttgcctatcagtcgttgaaacctccccctccaaagatatgcggatcgccaggcggtccgcccataagttcaccaagaatcaaactcagcgatgggaggtatttggcctacagggagaagggggttcctaaagaagaggctaagtacaaaattatcgttattcatggctttgacagctcaaaggatctggatttacctgtctccaaggatttcatagaggagctaagggtatatttccttttgttcgatagagcaggttatggagagagtgatccatatccatcacgctcagttaagagtgaagcatatgatatccaagaattggcagacaagttgcagatcgggccaaaattctatgtaattggagtatcaatgggagcctaccccatatacggttgcctaaaatacataccgcataggttggctggagcttccctcgtagttccatttgtacactactggtggccttgtctcccacccaatatatctagagagggcttacaaaggcttcagaaatctgatcaatggacatttcggattgcacatcatgcaccctggttgttctactggtggatgactcaaaaatggttcccttcattaagtattatgtcaggaaatgtagcaatcttttgcccacaagatatagagatgatgaagaagttatctgaaaccccaagtgttgttcaggaaaaggttcgccaacaaggtgttcatgagtctctgtatcgagacatgatagccggttatagcaaatgggaatttgatccctcagatataattaatcctttccccaacaatgaaggctcagtccacctttggcaaggttatgaagacagaatcattccttatcaaataaaccgatacatctcagagaagcttccatggattcgctatcatgaggttcctgatgctggacatttattgatcttcaggagtgacatatgtgagacaattcttaggtcacttcttcttggatga

SEQ ID NO: 87 - DNA, 1041 bp, Ricinus communis
atgtttactgttgcggcagcagcagtggtggtggtgagtcttgcagtgttaggatacgaaagggtaaagcctccacctccaaagatttgcgggtctccgagtggtcctccaattacttcaccaagaattaagcttagtgatggaaggcatttgtcttatagagaaaggggtgttacaaaagaaattgccaagtataaggtcattcttgttcatggttttgatagctctaaggacatctacttgccactatctcaagaggtgatggaagagctaggaatatatatcctgacatttgatagagcaggttatggagaaagtgatccaaacccagaaaggtcagtgaagagtgaagcatttgatatccaagaacttgctgaccaaatgcaactgggtccaaagttttatgtcattggagtttccattgggacttactccatttgggcttgcctcaagtatattccacacaggctagctggtgtgactctagtagttccagtcataaatttctggtggccatctttccctcctaaattggcaaatgaggcattcaggaaacaactcaggagagatcaagtaaaactgaccattgcacatcacttccctccactagtgtactggtggatgactcagaagctgtttccttattcctctatcatgcaaagacacccaatactactcaatccaagagatttagaaactataaagcaaatgtctcaagtgcctaatcctgatgagcataagataaggcagcaaggtgtccaggaatcactacatagagacatgatagtgcattttgggacatgggaatttgatccaatggagctaaagaatccatttcctaacaatgagacttctgtttacctgtgggaaggtcatgaagacaagcttgtgccatttgaattgcagagatatgttgctaagaagttaccatggatcaaatatcatgaagttcctgatggtggacatttgatgattcatgaaaagggcttgtgtgaggctatattcagggaacttttgcttggagaggaaccctttttttga

SEQ ID NO: 88 - DNA, 1050 bp, Ricinus communis
atgcttttaaaaatagcagttcttctgatgagtggtcttctaggcatggtttatcaggctacacagcttcctccacctcagaaggaagagtcacaagaaaatactcctgctaattcaccaagaatcagactcagtgatggaagatatctggcttacagagaaaaaggagtcaccaagaacaaatccaagtacaggatcattattgttcatggctttggaagctcaaaagaaatgaactttctggcaccccaagaactgatagaggaattagggatatattttctgctgtttgaccgagccggatatggagaaagtgatccgaacccaaatcgaattgtaaagagtgaagcgcatgacattgaagagcttgctgatcaattgcagataggatccaatttttatgtgataggagtctcaatgggctcataccctatctggagttgcctcaaatatataccacacaggctagcaggtacagcattaatagccccagttgtcaattacagatgggcttcacttcctcagaatttgataaggtatgattatagaaggaaacttatccagtgggcactctggttctctaaccatgcccctggattattacactggtgggttactcagcaatggcttccttcaacttctgtcctggaaaagaacccattattctttagcgatcaagacttagaagtcttgaagaagataccaggattccctatgttaagtaaggaaagattaagagagcgagatgtttttgataccctccgccgtgactttatggtgggttttggagattgggaatttgatcctgttgagctagaaaatccatatcctcaaaatgaaagctctgttcacatctggcaaggctacgaagacaaggttgtaccatttcaacttcagagattcataacaggaaagctaccctggattcgataccatgaagttcctcaaggtggacatctaattgtgcactataaaggtttctgtggggctgttttgaggtcgcttttacttggagaagaccctctagaactagaacaagttcatccataa

SEQ ID NO: 89 - DNA, 1077 bp, Ricinus communis
atggtactttctgaatcagacactattgtctatggcagcattaccaaatcaaactcaccaccattatcacatccacagtcacatttacaagacgagtcaatgaaggatgcttcattttctccattgagtggacaaaattcacttttgtcccttactctcaatgaaatccagcacaagagtggcaagagctttggttccatgaacatggatgagtttcttgctaacttgtggagtagtgtagaagaaaatcaagttactccacagccaaatcaactccagcatgccaaagacaatggtagtgtaattaacctgcctccattggcgcgacaaggctctttctccatccctgctccgctatgcaagaaaaccgtggatgaggtatggtttgagatacaaaaagagcaaccggaacgtcaaaaaccaagcaatattgatgctcgtgagccccctcaacgccaacagacgcttggagagatgacgctcgaagatttcttagtgaaagccggtgtagtccaggaagctacacagtcagcaggttcatcgctgcagaaaatggttacacctattcaaaatattaatgcatgtttggatgcaagttttggaatggggcaagtgatgggaatgggatttcctactgcccatcaaactattggaaacagtttctctaccggcaacggcttcgcgccataccagatgttccctcaaagcaaagggtttataggagaagcaccaaacaatgcgaaaaccgaacagggtcaaacggaattgggcatgcaacaaaacaagaaaaggataattgatggtccaccggaagtggtagtagagcggaggcaacgcaggatgataaagaatagagaatcagcagcacgatctcgagctaggaagcaggcgtatacggtcgagttggaattagagctaaatcaacttaaagaagagaatgcgaagttaaaactccttgtggaggaaatcgagcaaaatagaaaggaagaggttttgaggaggaagccattgataatgccaaaaaagaaggtagataaattgaggagcataaggaggacagtgagcttgacatggtga

SEQ ID NO: 90 - DNA, 3714 bp, Ricinus communis
atgttaagttcggggaataataatttaagccgtggaagtgccgcaatatcatcagatcttccaccattgacacaatgcttgcctttggagcaaattacgttaggcaatcagaaatatactcgctgtggagagttaaggagggctttgggtgttcctctaggaagtgcatcagaggattattcttttggagtttcccatcctaagcctcaatccctagcgggtacggaggagctaaaacattttaaagaaagtgttcaagatacttctagaaaggccagggatcgagcaaaaatgtggcgtgattccttattcaaattggacaagtatagggaagcgttgagttcaaagaagcgacagaggagcgaacttccgttgaatgagaggtcaaatggagcaactttagcaaagatggggagtcaggttcatagaaacagtcatgatattatggctcaaaggttggaggacagggctaaaaatattgggctgaataagcgggttcgtacatcagtggctgatgtgcgggtttatggtaggtcaaaccttgcctcaagacagcagatggtcatggagaagggtacagatatgctccaagattctggtggaggtactgttcggtttgaagaaaagatccgtagattgcctgctgggggtgaaggatgggatacaaaaaataagaaaaagcgctctattggagttgtgggtagtagaattttaaatggtgatcgagaaataaaacgagctatgcatcctaaaatcagtgctgagtctaagctgcgatcttgcgatactcagggtttcaggtcaaaatcttcccctggtgttagtggaatcagtaagttggatggtcctttagaacctactggttcagataccagtacagtgctcaggaatgaaatggatactgtaactcttccaagagaccgattagcactcctagagcagaaggctgtgacaaaaggaagcaataagccaaatgttaacgaagacaatttagcaagcagtcctaatacaatgatgaaagcaaaagctcgggcaccacgaactagctccatcatgatgctagactcatcgctcaaagttcagtcctcatctacatctcttcaaggtgcggaactacctgcaagttcaaataaagtaacaatgccttgtatgctaaataatcataagcgtcaaacatctgcaggttcatcttccgtggctcaatgggtaggtcaaaggcctaaaaactcacgcactaggagaacaaatatagttgctcctgtttcaaaccatgttgatgctcagatttcatctcaaggttttgcaaccaatgattttagcactagaacttccactgggacaaatggatctctaattgccaacagtatagataatcacactcctaagttcaagagagaaattgacattgggttatctgaaagtgaggaatcaggtgctggggacaataaaactaaagaaaaaggaataaacagtggcgaggttgctctaacttcatctcagagagctggtcattttcttttgccttctaaaaaaaataagttactcacaaatgaaattggagatggagttcggagacaaggaagaagtggaaggggttcatctttaacaaggccaggcattcacgtagtgagagagaaactagagaatctaccaacaataaagccacttcagagtgtgaatgctgtttctgataaaaataaaagcaaaactggtcggcccccttccaaaaagttgaaagatcggaagtcttcagctcgcgttgggccgataattaatagtggatctttagattatacaggcgaatctgatgatgatcgcgaggaactattttcagctgctaattctgctcggaatgcgagcaatcgtgcaagttgtggcccgttttggaagaaaatggaatctatttttgcttctgtaagctcagaggacttgtcctttctaaaggaacagcttagttttgctgacgagcttgatgagggtttgtctcagatgcttggtagtgaatgtaacctcttgggtgttcttgtgcaaaaggaactacctgattattgtggtgaaagacaaggtgatcactctaatcaagattcagttaagaaatctgctctatatggaaaagttgacatgggaagattggaaaagggtgctccattgtaccagagagttctttctgctttaattgaagaagatgaaagtgaagaattttatatccacagtgaagggaagaatatcccacttcactatgctagtgatgattctcattgtggttcatgtaatctgattgatattgaatccaaggatagggataggatggaatctgaagttgagtcaacagtggattttcagactcacaggaattctttcttggacagaatttcatgtgataagagtgttgcatctaacacatttagaaattcaagcatgtcaaactctttacatagcaatggtcagtggccaggagatgatgatttttcccattcagatattgtgcatgccagtgaaatatgttcaaatgatctcagtcagctgcagacaagggacttgaccatatctgccttcccctcctctgatcacaagtatcagctgatgtatcttgatgatagggttctgctggagttgcaaagtattggtctatgtccagagacattgcctgatctggcagagggggaggaaatgattggtcaagatataatggaactcaaggaaggcctataccagcagattggaaggaagaaaaggaagttagggagaattgataaggctgttcagaaagggaaagaagtggaaagaaggacgattgagcaaattgcaatggaccaacttgtcgagctggctcatagaaaacgactggcttgccgtcggaacaattcctcaaaaagtgcagtccgcaaggtttcaagacaagttgccctagcttttatcaagcgcactcttgccagatgtagaaaatttgaagatacagggagcagttgctttagtgagcctgcactacaggaggtcatcttctctacacctacatgcaataatgatgccaaatctgttgattgtgtcggctcaggtactgcaagtaacacatgcaatgaagtttctaaccatcatggcgaagccagaggatcagttgccatttccagcacttttgagatagatgattcacatggtgattacttcgatagagggaggaaaagggaagtgcttattgatgacgtgattggcagtgcttcatcaagggttacatcgagtcttgacagtgctgtgcttggtggagtgaagggcaagagaagtgacagagaaagggatataaacaaggatattataagatgtaattctgtttctggaactagtcactcatcattggatggcttgaaaaatgaccgcaaaacaaaatcaaaacccaagcaaaagaataatcatttatcgacatcaggaaatggacctcgtggatctagtcattcagtggctggtcccagcaataaattagacagtgcgggctcaatgtcgcttggggatgcttctaaggaagcagaagaacccattgattatgcaaacttgcagctgcatgaattagacacaattggattagaagtatccaatgagcttggcgggccacaggatcttggttcatggttgaattttgatgatgatgcgttgcaagaccatgattctatgggtcttgcaataccgatggatgacctcacagatttgcagatgcttatgtag

SEQ ID NO: 91 - DNA, 22 bp, Artificial sequence
  Single strand DNA oligonucleotide
gacgcagaacctgatgatgttg

SEQ ID NO: 92 - DNA, 21 bp, Artificial sequence
  Single strand DNA oligonucleotide
atctcctttgggcgactgtac

SEQ ID NO: 93 - DNA, 20 bp, Artificial sequence
  Single strand DNA oligonucleotide
tctctgcgtgaacaattgcg

SEQ ID NO: 94 - DNA, 20 bp, Artificial sequence
  Single strand DNA oligonucleotide
tgaaggcgagttttgcgttg

SEQ ID NO: 95 - DNA, 20 bp, Artificial sequence
  Single strand DNA oligonucleotide
tggtttccaagctgtgatgc

SEQ ID NO: 96 - DNA, 20 bp, Artificial sequence
  Single strand DNA oligonucleotide
tgtgctgatttcccaaagcc

SEQ ID NO: 97 - DNA, 20 bp, Artificial sequence
  Single strand DNA oligonucleotide
tggtgtgacttgccttgttg

SEQ ID NO: 98 - DNA, 22 bp, Artificial sequence
  Single strand DNA oligonucleotide
cctttccattgcttcagagagc

SEQ ID NO: 99 - DNA, 20 bp, Artificial sequence
  Single strand DNA oligonucleotide
aaagcttccatggctgtacc

SEQ ID NO: 100 - DNA, 19 bp, Artificial sequence
  Single strand DNA oligonucleotide
cccccacatatgcatctgc

SEQ ID NO: 101 - DNA, 20 bp, Artificial sequence
  Single strand DNA oligonucleotide
ttctaacggtgcccttttgg

SEQ ID NO: 102 - DNA, 22 bp, Artificial sequence
  Single strand DNA oligonucleotide
tccggactacctttccaagaac

SEQ ID NO: 103 - DNA, 22 bp, Artificial sequence
  Single strand DNA oligonucleotide
actctggtagtgatgacagacc

SEQ ID NO: 104 - DNA, 20 bp, Artificial sequence
  Single strand DNA oligonucleotide
tggccttggcatttcatagc

SEQ ID NO: 105 - DNA, 21 bp, Artificial sequence
  Single strand DNA oligonucleotide
accctggttgttctactggtg

SEQ ID NO: 106 - DNA, 20 bp, Artificial sequence
  Single strand DNA oligonucleotide
tggcgaaccttttcctgaac

SEQ ID NO: 107 - DNA, 20 bp, Artificial sequence
  Single strand DNA oligonucleotide
tgctgaccaaatgcaactgg

SEQ ID NO: 108 - DNA, 19 bp, Artificial sequence
  Single strand DNA oligonucleotide
acaccagctagcctgtgtg

SEQ ID NO: 109 - DNA, 20 bp, Artificial sequence
  Single strand DNA oligonucleotide
agcgcatgacattgaagagc

SEQ ID NO: 110 - DNA, 20 bp, Artificial sequence
  Single strand DNA oligonucleotide
tgtacctgctagcctgtgtg

SEQ ID NO: 111 - DNA, 20 bp, Artificial sequence
  Single strand DNA oligonucleotide
aacggaattgggcatgcaac

SEQ ID NO: 112 - DNA, 21 bp, Artificial sequence
  Single strand DNA oligonucleotide
ccgtatacgcctgcttcctag

SEQ ID NO: 113 - DNA, 20 bp, Artificial sequence
  Single strand DNA oligonucleotide
tgttgattgtgtcggctcag

SEQ ID NO: 114 - DNA, 20 bp, Artificial sequence
  Single strand DNA oligonucleotide
agtgctggaaatggcaactg

SEQ ID NO: 115 - DNA, 20 bp, Artificial sequence
  Single strand DNA oligonucleotide
atcgatcgaatcaaggaacg

SEQ ID NO: 116 - DNA, 22 bp, Artificial sequence
  Single strand DNA oligonucleotide
caccctcaatgttgtagtcacg

SEQ ID NO: 117 - DNA, 22 bp, Artificial sequence
  Single strand DNA oligonucleotide
gctgctatcaaggctgaatctg

SEQ ID NO: 118 - DNA, 20 bp, Artificial sequence
  Single strand DNA oligonucleotide
agccttggcgtcaaaaatgc

SEQ ID NO: 119 - protein, 172 aa, Ricinus communis
MAEEHRCQAQRLCVNNCGFFGSPATQNLCSKCHRDLQLKEQQSSNAKLAFSQTLSASSSSSSSSSSSPSAASVSISISSPPIVDLPEVSSKAEVVVEDKEETAAETVVRPNRCLTCRKRVGLTGFKCRCEMVFCGTHRYPEQHGCTFDFKAMGKKQIAKANPVVKAEKLEKI

SEQ ID NO: 120 - protein, 434 aa, Ricinus communis
MPKVIEFEDGSDTDISKIRTVHVQWLWWWADLAIPINRATDFISPMKRSVRPFFSILLLIVFAITLTCRILIRKGAFFSSIELEANVIVHPPLPVFNSTLLKYAAIDIGEAKSKQEIEQLLEGNFSSQGRYRTFATRRRFNNHDIRASSSRGIPVIFRSPQFYRYWLEFRRVLQDWSRTKRYQPDIMNELIQLVKIPIERRKGLMGSNKKYGSCAIVGNSGILLQKDYGELIDSHEMVFRLNNARTERFEQHVGSKTNVSFVNSNILHLCARRVGCFCHPYGADVPMVMYICQPVHMLDYTICNTSHKAPLIVTDPRFDVLCTRIVKYYSLKRFADETEKSLDEWSSTHDGSMFHYSSGFQAVMLAVGTCDKVSIFGFGKSAQAKHHYHTNQKSELRLHDYEAEYDFYHDLVSNPQLIPFISDRFKFPPVVIYQ

SEQ ID NO: 121 - protein, 815 aa, Ricinus communis
MKKVHETRSQTHGPAADEGKVMTRKQKAENKGHEGEQSPKKAKNENDSSHANEKTKTDISKEFEEFSRAIREHLSVSQMREILEMNDQDSSGSDGAVITKCQDLLLLGPLGKCPLCDCTLEFDGKRYSCNGFYSEWSSCTFKTRSPPRKEEPLKFPDSVLKSPIADLLKKHQDPKNRPRQELGAPGKPFAGMIISLSGRLSRTHQYWKKTIEKYGGKVSNSVIGVTCLVVSPAERERGGSSKLSEAMERNIPVAREEWLLDSIEKQEPLPLEAYDVVSDLAVEGKGIPWDKQETSEEALESISAELKLYGKRGVHKDSKLQERDGEIFEKDGILYNCAFSLCDMGREINDYCILQLINVPESNLHLYYKKGRVGDDPGADERLEEWEDVDNAVKEFVKIFEEITGNEFEPWEREKKFEKKRLKFYPIDMDDGVEVRQGGLGLRQLGAAAAHSKLEPQLAYFMKILCSQEIYRYALMEMGLDPPELPMGMLSDLHLKRCEEVLLQFVEAVKSMKGTGQKAEAVWSDYSQRWFTLMHSTRPLILRDYDELADNVAAAFETVRDINVASRLIGDMSGSTLDDPLSDRYKKLGCSISPVGKETDDYKMIVNYLERTYEPIRVGDIDYGVSVENIFAVESSAHPSLDEIKKLPNKVLLWCGTRSSNLLRHLQKGFLPAACSLPVPGYMFGKAIVCSDAAAEAARYGFTAVDRPEGFLILAVASLGDEVTEVSSTPEDTKSFEEKKIGVKGLGRKKTDESEHFMWRDDIKVPCGRLMPSENKDGPLEYNEYAVYDPKQTSIRFLVGIKYEEKDAVMDTAEP

SEQ ID NO: 122 - protein, 358 aa, Ricinus communis
MVLSESDTIVYGSITKSNSPPLSHPQSHLQDESMKDASFSPLSGQNSLLSLTLNEIQHKSGKSFGSMNMDEFLANLWSSVEENQVTPQPNQLQHAKDNGSVINLPPLARQGSFSIPAPLCKKTVDEVWFEIQKEQPERQKPSNIDAREPPQRQQTLGEMTLEDFLVKAGVVQEATQSAGSSLQKMVTPIQNINACLDASFGMGQVMGMGFPTAHQTIGNSFSTGNGFAPYQMFPQSKGFIGEAPNNAKTEQGQTELGMQQNKKRIIDGPPEVVVERRQRRMIKNRESAARSRARKQAYTVELELELNQLKEENAKLKLLVEEIEQNRKEEVLRRKPLIMPKKKVDKLRSIRRTVSLTW

SEQ ID NO: 123 - protein, 343 aa, Ricinus communis
MGLWNYHVQDNTNLCFQPPTFIEWLKPSSSSVTSSSSSSSCSSATQQVQLTNPSMTILKLPLLYPQQLENQDQFVKETIQCLPLFTEKEELKEEENMEVQESVVKEEKIDQVTVALHIGLPNTSSGDSDLDQVETKVSQEKQEQEQPFMIKKSFHGCTFNAESRFWIPTPAQILVGPMQFECSICSKTFNRYNNMQMHMWGHGSEFRRGPDSLRGTQPAAMLRLPCYCCAQGCKNNINHPRAKPLKDFRTLQTHYKRKHGAKPFMCRKCGKTFAVKGDWRTHEKNCGKLWYCTCGSDFKHKRSLKDHIRSFGKGHSPHPSLEGFEDDQKECITTGSEEDDFVR

SEQ ID NO: 124 - protein, 382 aa, Ricinus communis
MVVGSTKKIAVASATAHTRRNKATPTSFPLSLCINVQSFCPAMFVPIAVTVVVGLLGFAYQSLKPPPPKICGSPGGPPISSPRIKLSDGRYLAYREKGVPKEEAKYKIIVIHGFDSSKDLDLPVSKDFIEELRVYFLLFDRAGYGESDPYPSRSVKSEAYDIQELADKLQIGPKFYVIGVSMGAYPIYGCLKYIPHRLAGASLVVPFVHYWWPCLPPNISREGLQRLQKSDQWTFRIAHHAPWLFYWWMTQKWFPSLSIMSGNVAIFCPQDIEMMKKLSETPSVVQEKVRQQGVHESLYRDMIAGYSKWEFDPSDIINPFPNNEGSVHLWQGYEDRIIPYQINRYISEKLPWIRYHEVPDAGHLLIFRSDICETILRSLLLG

SEQ ID NO: 125 - protein, 349 aa, Ricinus communis
MLLKIAVLLMSGLLGMVYQATQLPPPQKEESQENTPANSPRIRLSDGRYLAYREKGVTKNKSKYRIIIVHGFGSSKEMNFLAPQELIEELGIYFLLFDRAGYGESDPNPNRIVKSEAHDIEELADQLQIGSNFYVIGVSMGSYPIWSCLKYIPHRLAGTALIAPVVNYRWASLPQNLIRYDYRRKLIQWALWFSNHAPGLLHWWVTQQWLPSTSVLEKNPLFFSDQDLEVLKKIPGFPMLSKERLRERDVFDTLRRDFMVGFGDWEFDPVELENPYPQNESSVHIWQGYEDKVVPFQLQRFITGKLPWIRYHEVPQGGHLIVHYKGFCGAVLRSLLLGEDPLELEQVHP

SEQ ID NO: 126 - protein, 394 aa, Ricinus communis
MGKRDKKQRHHNQHRSRVASYYNTEQEDDGYSYSQSSLPNEDSDAEPDDVEEEEEEEEEKEDTSDAKASNDVPSKFLLYQQSVQSPKGDISYLQKFFLLYVGGRLPLHFQEDFCGTALLSTEWLRSDSRRTAVGVDLDLEALNWCMANNVNKIGADGYSRISLFHGNVLQPSDAELVRFEPQDLISNIKLGEQGDNSENTALESALQVGSSASVSDKYLKRNFQLPARDIVCAFNYSCCCLHKRADLVLYFKHVLDALSKKGGLFVMDLYGGTSSEGKLRLQRRFPNFTYIWEQAEFNIIERKTRISLHFHLQKQQKKLRHAFSYSWRLWSLPEIRDCLEEAGFKSIHFWLRRMPDSKDNRSVEGFGFGRDIKYEEVKTFEQEDSWNAYIVAVA

SEQ ID NO: 127 - protein, 409 aa, Ricinus communis
MEAAVITKTTTVFRLPPSPLCFAALRHRNSSFSSSTKTSLLFPRFKASHQLITRCAVERPDTGSYDGAGESYDAASAINLTNGSNFLQSLFDFTSSNFLPIALISAVALGMASPTLGCYAHKYSLSKFTTFGIFFISGLKLKGKEIGEVAEAWPVAIFGLASILLFTPFFSYLILQVRLAPQEFVTGLAIFCCVPTTLTSGVALTQLVGGNTALALAMTVISNLLGVLTVPFWVSKFLADGFGVSIPTKNLFWSLIFTLLVPLVLGKVVRNSFKGLATYIDENSRTFSVINTFLLSLTPWMQVSKSRSLLLLVKPQVFTEAIAMGILVHLVLLGFNIILVKALSAGFGGRESVLAKRKNARALLIVCSQKALLTVIVVVEQLSGALGQSGLLILPCVAAHINQFFTGTA

SEQ ID NO: 128 - protein, 69 aa, Ricinus communis
MVSYEMPRPNIGIHRFVFLLFKQQRRQTVKPPTSRDRFNSRKFAEENELGLPVAAVFFNAQRETAARRR

SEQ ID NO: 129 - protein, 346 aa, Ricinus communis
MFTVAAAAVVVVSLAVLGYERVKPPPPKICGSPSGPPITSPRIKLSDGRHLSYRERGVTKEIAKYKVILVHGFDSSKDIYLPLSQEVMEELGIYILTFDRAGYGESDPNPERSVKSEAFDIQELADQMQLGPKFYVIGVSIGTYSIWACLKYIPHRLAGVTLVVPVINFWWPSFPPKLANEAFRKQLRRDQVKLTIAHHFPPLVYWWMTQKLFPYSSIMQRHPILLNPRDLETIKQMSQVPNPDEHKIRQQGVQESLHRDMIVHFGTWEFDPMELKNPFPNNETSVYLWEGHEDKLVPFELQRYVAKKLPWIKYHEVPDGGHLMIHEKGLCEAIFRELLLGEEPFF

SEQ ID NO: 130 - protein, 1237 aa, Ricinus communis
MLSSGNNNLSRGSAAISSDLPPLTQCLPLEQITLGNQKYTRCGELRRALGVPLGSASEDYSFGVSHPKPQSLAGTEELKHFKESVQDTSRKARDRAKMWRDSLFKLDKYREALSSKKRQRSELPLNERSNGATLAKMGSQVHRNSHDIMAQRLEDRAKNIGLNKRVRTSVADVRVYGRSNLASRQQMVMEKGTDMLQDSGGGTVRFEEKIRRLPAGGEGWDTKNKKKRSIGVVGSRILNGDREIKRAMHPKISAESKLRSCDTQGFRSKSSPGVSGISKLDGPLEPTGSDTSTVLRNEMDTVTLPRDRLALLEQKAVTKGSNKPNVNEDNLASSPNTMMKAKARAPRTSSIMMLDSSLKVQSSSTSLQGAELPASSNKVTMPCMLNNHKRQTSAGSSSVAQWVGQRPKNSRTRRTNIVAPVSNHVDAQISSQGFATNDFSTRTSTGTNGSLIANSIDNHTPKFKREIDIGLSESEESGAGDNKTKEKGINSGEVALTSSQRAGHFLLPSKKNKLLTNEIGDGVRRQGRSGRGSSLTRPGIHVVREKLENLPTIKPLQSVNAVSDKNKSKTGRPPSKKLKDRKSSARVGPIINSGSLDYTGESDDDREELFSAANSARNASNRASCGPFWKKMESIFASVSSEDLSFLKEQLSFADELDEGLSQMLGSECNLLGVLVQKELPDYCGERQGDHSNQDSVKKSALYGKVDMGRLEKGAPLYQRVLSALIEEDESEEFYIHSEGKNIPLHYASDDSHCGSCNLIDIESKDRDRMESEVESTVDFQTHRNSFLDRISCDKSVASNTFRNSSMSNSLHSNGQWPGDDDFSHSDIVHASEICSNDLSQLQTRDLTISAFPSSDHKYQLMYLDDRVLLELQSIGLCPETLPDLAEGEEMIGQDIMELKEGLYQQIGRKKRKLGRIDKAVQKGKEVERRTIEQIAMDQLVELAHRKRLACRRNNSSKSAVRKVSRQVALAFIKRTLARCRKFEDTGSSCFSEPALQEVIFSTPTCNNDAKSVDCVGSGTASNTCNEVSNHHGEARGSVAISSTFEIDDSHGDYFDRGRKREVLIDDVIGSASSRVTSSLDSAVLGGVKGKRSDRERDINKDIIRCNSVSGTSHSSLDGLKNDRKTKSKPKQKNNHLSTSGNGPRGSSHSVAGPSNKLDSAGSMSLGDASKEAEEPIDYANLQLHELDTIGLEVSNELGGPQDLGSWLNFDDDALQDHDSMGLAIPMDDLTDLQMLM

What is claimed is:

1. A non-genetically modified determinate castor plant comprising a genome having a deletion comprising coordinates 60520-152129 of the sequence set forth in Scaffold 30055 (SEQ ID NO: 1).

2. The plant of claim 1, wherein said deletion is flanked by primers L3-F (SEQ ID NO: 10) and R6-R (SEQ ID NO: 57).

3. The plant of claim 1, having a stable vigor for at least 5 generations.

4. A method of selecting a determinate castor plant, the method comprising identifying in the genome of a castor plant using molecular markers to identify in the DNA of said castor plant a deletion comprising coordinates 60520-152129 of the sequence set forth in Scaffold 30055 (SEQ ID NO: 1), the deletion being indicative of a determinate castor plant.

5. A method of producing oil, the method comprising:
(a) providing seeds of the castor plant of claim 1;
(b) extracting oil from said seeds.

6. A cake of the castor plant of claim 1, said cake comprising DNA of the castor plant having a deletion comprising coordinates 60520-152129 of the sequence set forth in Scaffold 30055 (SEQ ID NO: 1).

7. A method of producing a cake, the method comprising:
(a) providing seeds of the castor plant of claim 1;
(b) crushing said seeds so as to obtain crushed seeds; and
(c) removing oil from said crushed seeds, thereby producing the cake.

8. A castor meal produced from the plant of claim 1, said castor meal comprising DNA of the castor plant having a deletion comprising coordinates 60520-152129 of the sequence set forth in Scaffold 30055 (SEQ ID NO: 1).

9. A processed product of the castor plant of claim 1, wherein the product comprises DNA of the castor plant having a deletion comprising coordinates 60520-152129 of the sequence set forth in Scaffold 30055 (SEQ ID NO: 1).

* * * * *